US010858438B2

(12) United States Patent
Kuenkele et al.

(10) Patent No.: US 10,858,438 B2
(45) Date of Patent: Dec. 8, 2020

(54) TRAILR2 CDH17 BINDING MOLECULES FOR THE TREATMENT OF CANCER

(71) Applicant: Boehringer Ingelheim International GmbH, Ingelheim am Rhein (DE)

(72) Inventors: Klaus-Peter Kuenkele, Marzling (DE); Timothy Fenn, Greenwich, CT (US); Juan Manuel Garcia-Martinez, Vienna (AT); Jason Ho, Collegeville, PA (US); Christian Koessl, Vienna (AT); Saurabh Sen, Sandy Hook, CT (US); Vladimir Voynov, Danbury, CT (US); Andreas Wernitznig, Vienna (AT)

(73) Assignee: Boehringer Ingelheim International GmbH, Ingelheim am Rhein (DE)

( * ) Notice: Subject to any disclaimer, the term of this patent is extended or adjusted under 35 U.S.C. 154(b) by 189 days.

(21) Appl. No.: 15/850,895

(22) Filed: Dec. 21, 2017

(65) Prior Publication Data

US 2018/0179287 A1    Jun. 28, 2018

Related U.S. Application Data

(60) Provisional application No. 62/437,770, filed on Dec. 22, 2016.

(30) Foreign Application Priority Data

Feb. 14, 2017   (EP) ..................................... 17155973

(51) Int. Cl.
*C12N 15/13* (2006.01)
*C12N 15/11* (2006.01)
(Continued)

(52) U.S. Cl.
CPC .......... *C07K 16/2866* (2013.01); *A61P 35/00* (2018.01); *C07K 16/28* (2013.01);
(Continued)

(58) Field of Classification Search
None
See application file for complete search history.

(56) References Cited

U.S. PATENT DOCUMENTS

| 4,676,980 A | 6/1987 | Segal et al. |
| 5,731,168 A | 3/1998 | Carter et al. |
| 2006/0269555 A1* | 11/2006 | Salcedo ................ A61K 45/06 424/155.1 |

FOREIGN PATENT DOCUMENTS

| EP | 0307434 A1 | 3/1989 |
| WO | 1988001649 A1 | 3/1988 |

(Continued)

OTHER PUBLICATIONS

Su et al., Cadherin-17 is a useful diagnostic marker for adenocarcinomas of the digestive system, Modern Pathol. 21:1379-1386, 2008.*

(Continued)

*Primary Examiner* — Claire Kaufman
(74) *Attorney, Agent, or Firm* — Edouard G. Lebel

(57) ABSTRACT

This invention relates to binding molecules that bind specifically to TNF-related apoptosis-inducing ligand receptor 2 (TRAILR2) and cadherin-17 (CDH17) and their use in medicine, pharmaceutical compositions comprising the same, and methods of using the same as agents for treatment and/or prevention of cancer.

42 Claims, 19 Drawing Sheets

Specification includes a Sequence Listing.

(51) Int. Cl.

| | |
|---|---|
| C12N 5/10 | (2006.01) |
| C07K 16/30 | (2006.01) |
| C07K 16/28 | (2006.01) |
| A61P 35/00 | (2006.01) |
| A61K 39/00 | (2006.01) |

(52) U.S. Cl.
CPC .... *C07K 16/2878* (2013.01); *A61K 2039/505* (2013.01); *C07K 2317/14* (2013.01); *C07K 2317/31* (2013.01); *C07K 2317/35* (2013.01); *C07K 2317/622* (2013.01); *C07K 2317/64* (2013.01); *C07K 2317/73* (2013.01)

(56) References Cited

FOREIGN PATENT DOCUMENTS

| | | | |
|---|---|---|---|
| WO | 1990005144 | A1 | 5/1990 |
| WO | 1991017271 | A1 | 11/1991 |
| WO | 1993008829 | A1 | 5/1993 |
| WO | 1994004678 | A1 | 3/1994 |
| WO | 1994013804 | A1 | 6/1994 |
| WO | 1994029348 | A2 | 12/1994 |
| WO | 1998025971 | A1 | 6/1998 |
| WO | 1998048837 | A1 | 11/1998 |
| WO | 2001079258 | A1 | 10/2001 |
| WO | 2002056910 | A1 | 7/2002 |
| WO | 2003050531 | A2 | 6/2003 |
| WO | 2004081026 | A2 | 9/2004 |
| WO | 2007042309 | A2 | 4/2007 |
| WO | 2009089004 | A1 | 7/2009 |
| WO | 2011039126 | A1 | 4/2011 |
| WO | 2012054084 | A2 | 4/2012 |

OTHER PUBLICATIONS

Anders, Robert A. et al. "Contribution of the Lymphotoxin β Receptor to Liver Regeneration1" (2005) The Journal of Immunology, 175: 1295-1300.

Brennan, Maureen et al. "Preparation of Bispecific Antibodies by Chemical Recombination of Monoclonal Immunoglobulin G1 Fragments" (1985) Science vol. 229, 81-83.

Brunker, Peter et al. "RG7386 a Novel Tetravalent FAP-DR5 Antibody Effectively Triggers FAP-Dependent, Avidity-Driven DR5 Hyperclustering and Tumor Cell Apoptosis" (2016) Molecular Cancer Therapeutics, vol. 15, No. 5, 946-957.

Gallmeier, Eike et al. "Loss of TRAIL-Receptors is a Recurrent Feature in Pancreatic Cancer and Determines the Prognosis of Patients with No Nodal Metastasis after Surgery" (2013) PLOS ONE, vol. 8, No. 2, e56760, 10 pgs.

Gruber, Meegan et al. "Efficient Tumor Cell Lysis Mediated by a Bispecific Single Chain Antibody Expressed in *Escherichia coli*1" (1994) Journal of Immunology, 152, 5368-5374.

Haybaeck, Johannes et al. "A lymphotoxin-driven pathway to hepatocellular carinoma" (2009) Cancer Cell, 16(4): 295-308.

He, Yuan et al. "Melanoma-Directed Activation of Apoptosis Using a Bispecific Antibody Directed at MCSP and TRAIL Receptor-2/Death Receptor-5" (2016) Journal of Investigative Dermatology, vol. 136, No. 2, 541-544.

Holliger, Philipp et al. ""Diabodies": Small bivalent and bispecific antibody fragments" (1993) Proc. Natl. Acad. Sci., vol. 90, 6444-6448.

Hoogwater, Frederik J.H. et al. "Oncogenic K-Ras turns Death Receptors into Metastasis-Promoting Receptors in Human and Mouse Colorectal Cancer Cells" (2010) Gastroenterology, 138: 2357-2367.

International Search Report PCT/EP2017/084002 dated Jun. 20, 2018.

Ito, Reiko et al. "Clincopathological significant and prognostic influence of cadherin-17 expression in gastric cancer" (2005) Virchows Arch, 447: 717-722.

Koornstra, Jan J. et al. "Expression of tumour necrosis factor-related apoptosis-inducing ligand death receptors in sporadic and hereditary colorectal tumours: Potential targets for apoptosis induction" (2005) European Journal of Cancer, 41, 1195-1202.

Kostelny, Sheri A. et al. "Formation of a Bispecific Antibody by the Use of Leucine Zippers" (1992) The Journal of Immunology, vol. 148, No. 5, 1547-1553.

Koyama, Shohei et al. "Expression of TNF-related apoptosis-inducing ligand (TRAIL) and its receptors in gastric carcinoma and tumor-infiltrating lymphocytes: a possible mechanism of immune evasion of the tumor" (2002) J Cancer Res Clin Oncol, 128: 73-79.

Luque-Garcia, Jose Luis et al. "Differential protein expression on the cell surface of colorectal cancer cells associated to tumor metastasis" (2010) Proteomics, vol. 10, 940-952.

Michaelson, Jennifer S. et al. "Anti-tumor activity of stability-engineered IgG-like bispecific antibodies targeting TRAIL-R2 and LTβR" (2009) MABS, 1:2, 128-141.

Panarelli, Nicole C. et al. "Tissue-Specific Cadherin CDH17 is a Useful Marker of Gastrointestianal Adenocarcinomas with Higher Sensitivity than CDX2" (2012) Am J Clin Pathol, 138: 211-222.

Su, Min-Cheng et al. "Cadherin-17 is a useful diagnostic marker for adenocarcinomas of the digestive system" (2008) Modern Pathology, 21: 1379-1386.

Swers, Jeffery S. et al. "Multivalent Scaffold Proteins as Superagonists of TRAIL Receptor 2—Induced Apoptosis" (2013) Mol Cancer Ther, 12: 1235-1244.

Takamura, Masaaki et al. "Expression of liver-intestine cadherin and its possible interaction with galectin-3 in ductal adenocarcinoma of the pancreas" (2003) Cancer Sci, vol. 94, No. 5, 425-430.

Traunecker, Andre et al. "Bispecific single chain molecules (Janusins) target cytotoxic lymphocytes on HIV infected cells" (1991) The EMBO Journel, vol. 10, No. 12, 3655-3659.

Tutt, Alison et al. "Trispecific F(ab')3 Derivatives that Use Cooperative Signaling via the TCR/CD3 Complex and CD2 to Activate and Redirect Resting Cytotoxic T Cells1" (1991) The Journal of Immunology, vol. 147, 60-69.

Van Geelen, Caroline M. et al. "Prognostic Significance of Tumor Necrosis Factor-Related Apoptosis-Inducing Ligand and its Receptors in Adjuvantly Treated Stage III Colon Cancer Patients" (2006) Journal of Clinical Oncology, vol. 24, No. 31, 4998-5004.

Zhang, Peng et al. "Targeting a Novel N-terminal Epitope of Death Receptor 5 Triggers Tumor Cell Death" (2010) Journal of Biological Chemistry, vol. 285, No. 12, pp. 8953-8966.

Altschul, Stephen F. et al. "Basic local alignment search tool" (1990) Journal of Molecular Biology, vol. 215, Issue 3, 403-410 (Abstract only).

Altschul, Stephen F. et al. "Gapped BLAST and PSI-BLAST: a new generation of protein database search programs" (1997) Nucleic Acids Research, vol. 25, No. 17, 3389-3402.

Barbas III, Carlos F. et al. "In vitro evolution of a neutralizing human antibody to human immunodeficiency virus type 1 to enhance affinity and broaden strain cross-reactivity" (1994) PNAS, vol. 91, 3809-3813.

Billetta, Rosario, et al. "Chimeric Antibodies" (1993) International Reviews of Immunology, vol. 10, 165-176.

Boackle, Robert J. et al "An IgG primary sequence exposure theory for complement activation using synthetic peptides" (1979) Nature, 282, 742-743 (Abstract).

Bruggemann, Marianne et al. "Production of human antibody repertoires in transgenic mice" (1997) Current Opinion in Biotechnology, 8: 455-458.

Brunhouse, Robert et al. "Isotypes of IgG: Comparsion of the Primary Structures of Three Pairs of Isotypes Which Differ in Their Ability to Activate Complement" (1979) Molecular Immunology, vol. 16, 907-917.

Burton, DR et al. "The C1q receptor site on immunoglobulin G." (1980) Nature, 288, 338-344 (Abstract only).

Carmen, Sara et al. "Concepts in antibody phage display" (2002) Briefings in Functional Genomics and Proteomics, vol. 1, No. 2, 189-203.

Chothia, Cyrus et al. "Canonical Structures for the Hypervariable Regions of Immunoglobins" (1987) J. Mol. Biol., vol. 196, 901-917.

(56) References Cited

OTHER PUBLICATIONS

Cole, S.P.C. et al. "Human monoclonal antibodies" (1984) Molecular and Cellular Biochemistry, 62, 109-120.
Cote, Richard J. et al. "Generation of human monoclonal antibodies reactive with cellular antigens" PNAS, (1983) vol. 80, 2026-2030.
Darling, Ryan J. et al. "Kinetic Exclusion Assay Technology: Characterization of Molecular Interactions" (2005) Assay and Drug Development Technologies, vol. 2, No. 6, (Abstract only).
Frank, Sandra K. et al. "High-Performance Liquid Chromatographic Assay for the Experimental Anticancer Agent Oxantrazole" (1987) Journal of Chromatography, 419, 225-232.
Giudicelli V. et al. "IMGT/V-QUEST: IMGT standardized analysis of the immunoglobulin (IG) and T cell receptor (TR) nucleotide sequences". Cold Spring Harb Protoc. 2011; (6): Abstract.
Hayden, M.A. et al. "Gene synthesis by serial cloning of oligonucleotides" (1988) DNA, vol. 8, 571-577 (Abstract only).
Hezareh, Marjan et al. "Effector Function Activities of a Panel of Mutants of a Broadly Neutralizing Antibody against Human Immunodeficiency Virus Type 1" (2001) Journal of Virology, vol. 75, No. 24, 12161-12168.
Higgins, Desmond G. et al. "Using CLUSTAL for Multiple Sequence Alignments" (1996) Methods in Enzymology, vol. 266, 383-402.
Huston, James S. et al. "Medical Applications of Single-Chain Antibodies" (1993) Intern. Rev. Immunol., vol. 10, 195-217.
Ichikawa, Kimihisa et al. "Tumoricidal activity of a novel anti-human DR5 monoclonal antibody without hepatocyte cytotoxicity" (2001) Nature Medicine, vol. 7, No. 8, 954-960.
Idusogie, Esohe E. et al. "Mapping of the C1q Binding Site on Rituxan, a Chimeric Antibody with a Human IgG1 Fc" (2000) The Journal of Immunology, 164: 4178-4184.
Karlin, Samuel et al. "Applications and statistics for multiple high-scoring segments in molecular sequences" (1993) PNAS, vol. 90, 5873-5877.
Karlin, Samuel et al. "Methods for assessing the statistical significance of molecular sequence features by using general scoring schemes" (1990) PNAS, vol. 87, 2264-2268.
Kipriyanov, S.M. et al. "Recent advances in the generation of bispecific antibodies for tumor immunotherapy" (2004) Current Opinion Drug Discovery Development, vol. 2, 233-242, (Abstract only).
Knappik, Achim et al. "Fully Synthetic Human Combinatorial Antibody Libraries (HuCAL) Based on Modular Consensus Frameworks and CDRs Randomized with Trinucleotides" (2000) 296, 57-86.
Kohler, G. et al. "Continuous cultures of fused cells secreting antibody of predefined specificity" (1975) Nature, 256, 495-497 (Abstract only).
Kozbor, D. et al. "Specific Immunoglobulin Production and Enhanced Tumorigenicity Following Ascites Growth of Human Hybridomas" (1985) Journal of Immunological Methods, vol. 81, 31-42.
Lafranc, Marie-Paule et al. "IMGT unique numbering for immunoglobulin and T cell receptor variable domains and Ig superfamily V-like domains" (2003) Developmental & Comparative Immunology, vol. 27, 55-77.
Li, Yang et al. "Hepatocyte growth factor enhances death receptor-induced apoptosis by up-regulating DR5" (2008) BMC Cancer, 12 pgs.
Lonberg, Nils et al. "Human Antibodies from Transgenic Mice" (1995) International Reviews of Immunology, vol. 13, 65-93, (Abstract only).
Lukas, Thomas J. et al. "Inhibition of C1-Mediated Immune Hemolysis by Monomeric and Dimeric Peptides from the Second Constant Domain of Human Immunoglobulin G1" (1981) The Journal of Immunology, vol. 127, No. 6, 2555-2560.
Malmqvist, Magnus "Surface plasmon resonance for detection and measurement of antibody-antigen affinity and kinetics" (1993) Current Opinion in Immunology, vol. 5, Issue 2, 282-286 (Abstract only).

Marks, James D. et al. "By-passing Immunization Human Antibodies from V-gene Libraries Displayed on Phage" (1991) J. Mol. Biol., vol. 222, 581-597.
Marks, James D. et al. "By-Passing Immunization: Building High Affinity Human Antibodies by Chain Shuffling" (1992) Biotechnology, vol. 10, 779-783, (Abstract only).
Milstein, C. et al. "Hybrid hybridomas and their use in immunohistochemistry" (1983) Nature, 305, Abstract.
Morgan, A. et al. "The N-terminal end of the CH2 domain of chimeric human IgG1 anti-HLA-DR is necessary for C1q, FcyRI and FcyRIII binding" (1995) Immunology, 86, 319-324.
Myers, Eugene W. et al. "Optimal alignments in linear space" (1988) CABIOS, vol. 4, No. 1, 11-17.
Niatoni, Alessandro et al. "TRAIL signals to apoptosis in chronic lymphocytic leukaemia cells primarily through TRAIL-R1 whereas cross-linked agonistic TRAIL-R2 antibodies facilitate signalling via TRAIL-R2" (2007) British Journal of Haematology, vol. 139, 568-577.
Norderhaug, Lars et al. "Versatile vectors for transient and stable expression of recombinant antibody molecules in mammalian cells" (1997) 204, 77-87.
Orlandi, Rosaria et al. "Cloning immunoglobulin variable domains for expression by the polymerase chain reaction" (1989) PNAS, vol. 86, 3833-3837.
Pearson, William R. et al. "Improved tools for biological sequence comparison" (1988) PNAS, vol. 85, 2444-2448.
Pukac, L. et al "HGS-ETRI, a fully human TRAIL-receptor I monoclonal antibody, induces cell death in multiple tumour types in vitro and in vivo" (2005) British Journal of Cancer, 92, 1430-1441.
Revets, Hilde et al. "Nanobodies as novel agents for cancer therapy" (2005) Expert Opinion on Biological Therapy, vol. 5, 111-124 (Abstract only).
Riechmann, Lutz et al. "Reshaping human antibodies for therapy" (1998) Nature, vol. 332, 323-327.
Schier, Robert et al. "Identification of functional and structural amino-acid residues by parsimonious mutagenesis" (1996) Gene, 147-155.
Srinivasan, Mythily et al. "Immunomodulatory Peptides from IgSF Proteins: A Review" (2005) Current Protein & Peptide Science, vol. 6, Issue 2, (Abstract only).
Stemmer, Willem P.C. et al. "Single-step assembly of a gene and entire plasmid from large numbers of oligodeoxyribonucleotides" (1995) Gene, 164, 49-53.
Thommesen, John E. et al. "Lysine 322 in the human IgG3 CH2 domain is crucial for antibody dependent complement activation" (2000) Molecular Immunology, 37, 995-1004.
Torelli, Alberto et al. "ADVANCE and ADAM: two algorithms for the analysis of global similarity between homologous informational sequences" (1994) Bioinformatics, vol. 10, Issue 1, 3-5, (Abstract only).
UniProtKB—O14763 (TR10B_Human) Protein: Tumor necrosis factor receptor superfamily member 10B, Gene: TNFRSF10B, (2001) 17 pgs.
UniProtKB—Q12864 (CAD17_Human) Protein: Cadherin-17, Gene: CDH17, (2001), 13 pgs.
Ward, E. Sally et al. "Binding activites of a repertoire of single immunoglobulin variable domains secreted from *Escherichia coli*" (1989) Letters to Nature, vol. 341, 544-546.
Winter, Greg et al. "Man-made antibodies" (1991) Nature, vol. 349, 293-299.
Yada, A. et al. "A novel humanized anti-human death receptor 5 antibody CS-1008 induces apoptosis in tumor cells without toxicity in hepatocytes" (2008) Annals of Oncology, 19, 1060-1067.
Ye, Qi-Zhuang et al. "Gene Synthesis and Expression in *E. coli* for Pump, A Human Matrix Metalloproteinase" (1992) Biochemical and Biophysical Research Communications, vol. 186, No. 1, 143-149.
Zhang, Liang et al. "Lexatumumab (TRAIL-receptor 2 mAb) induces expression of DR5 and promotes apoptosis in primary and metastatic renal cell carcinoma in a mouse orthotopic model" (2007) Cancer Letters, 251, 146-157.

* cited by examiner

Fig. 4
A
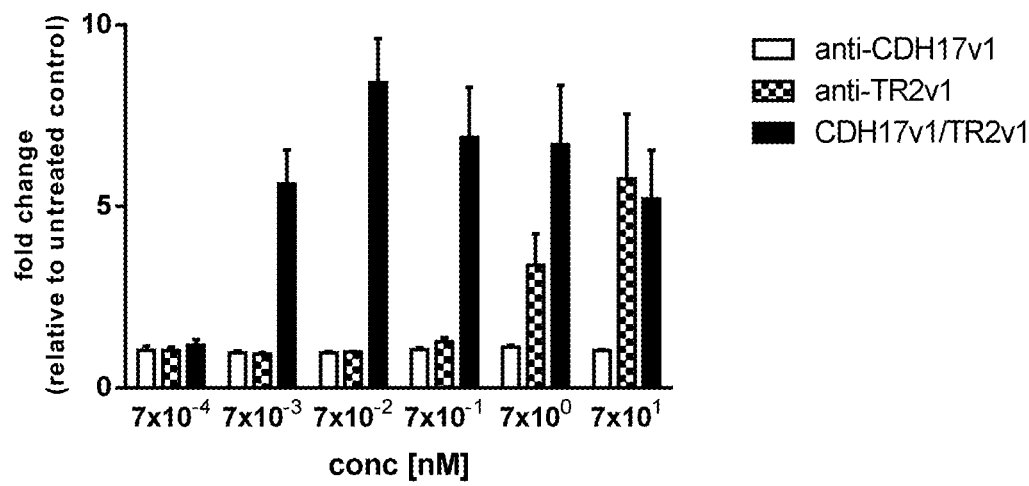
B
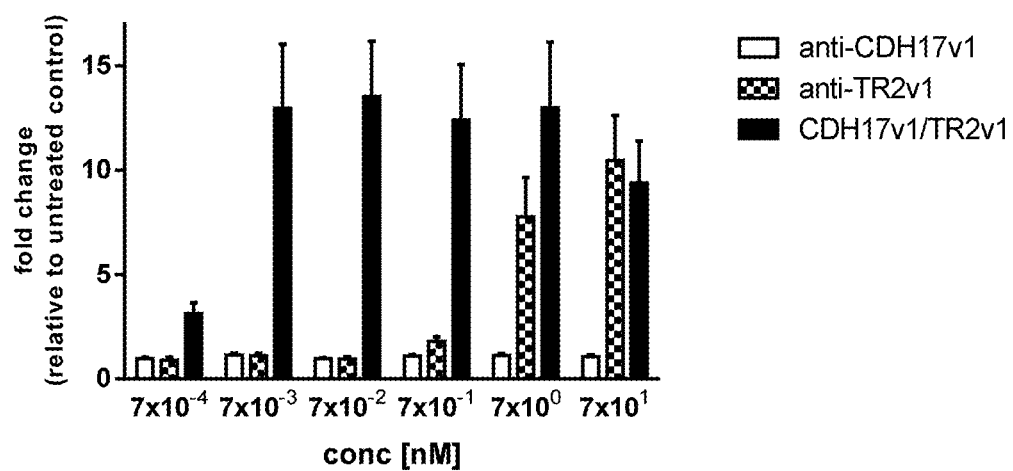

Fig. 6
A
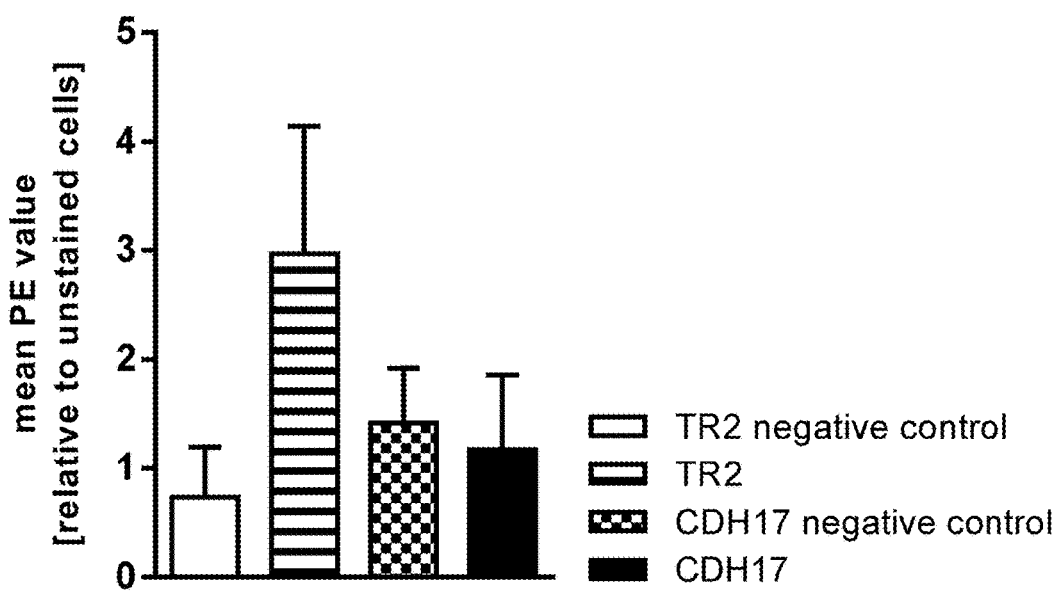
B
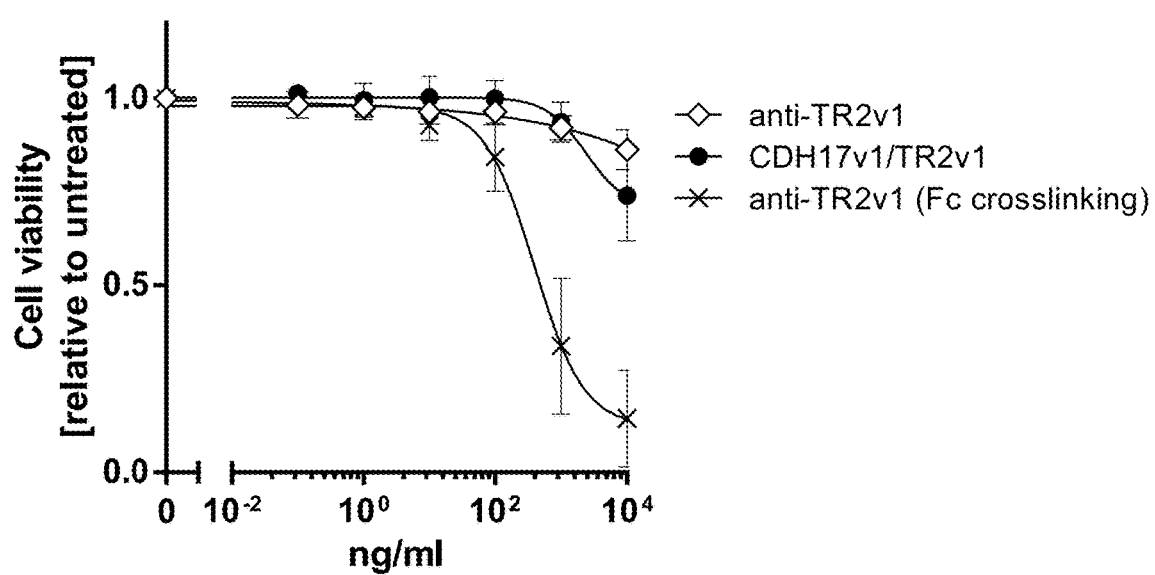

Fig. 7: page 1
A
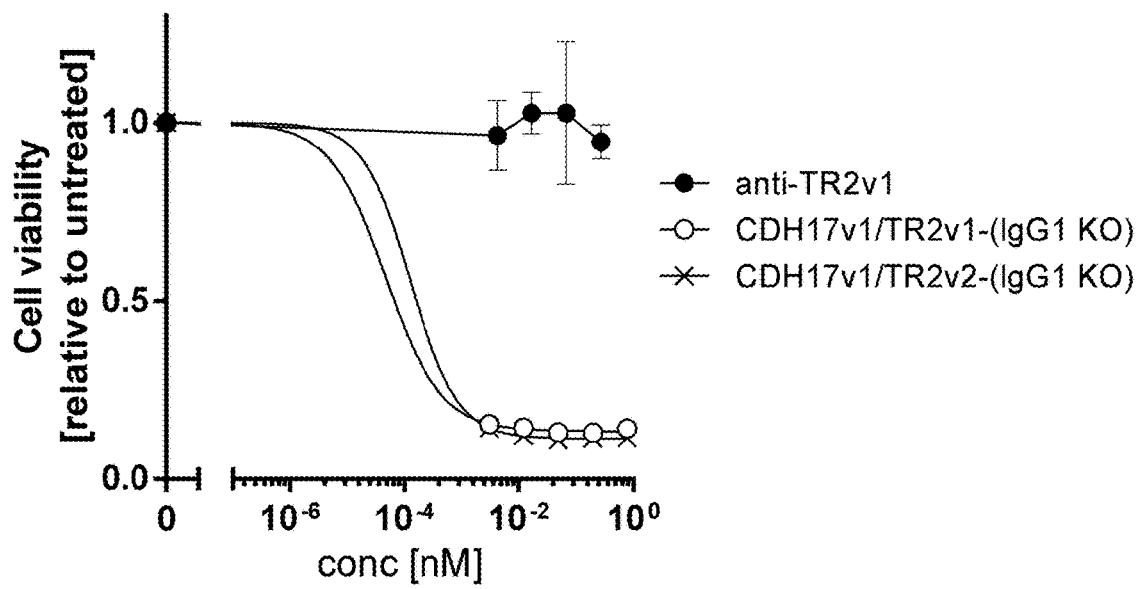
B
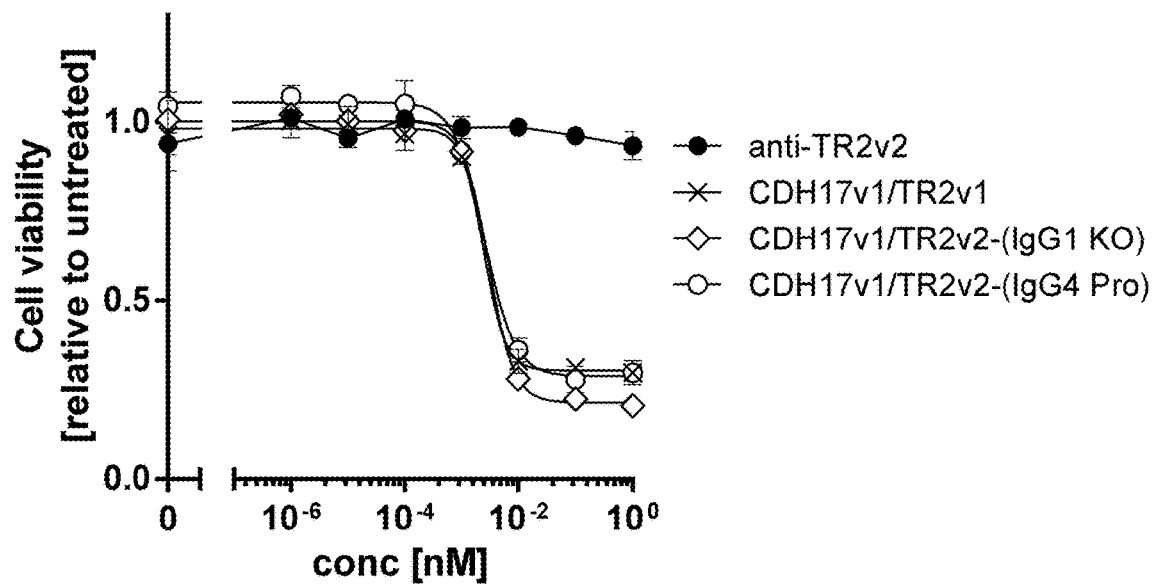

Fig. 7: page 2
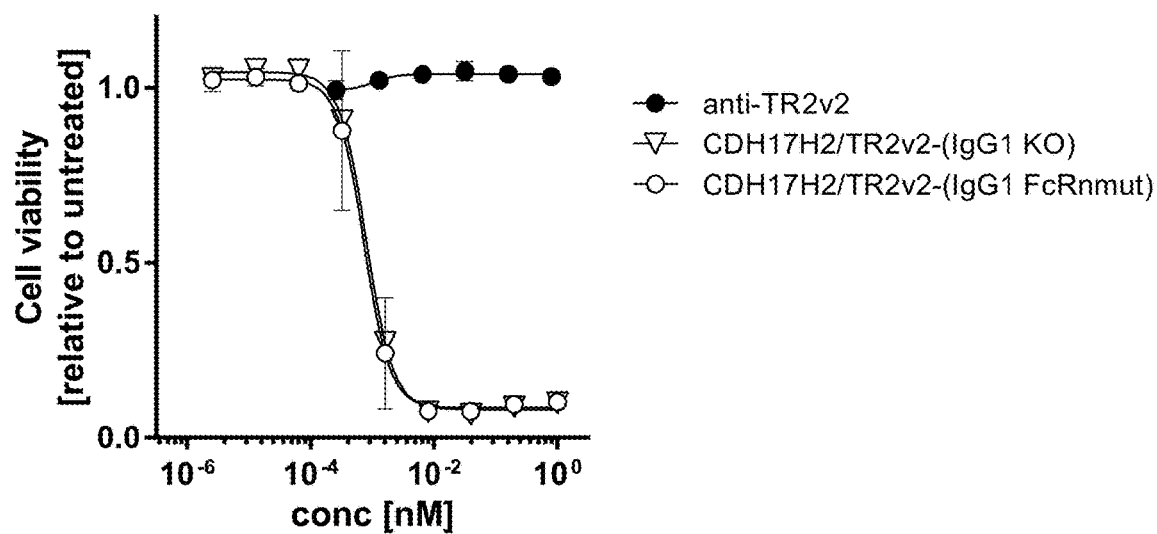

Fig. 9: page 1
A
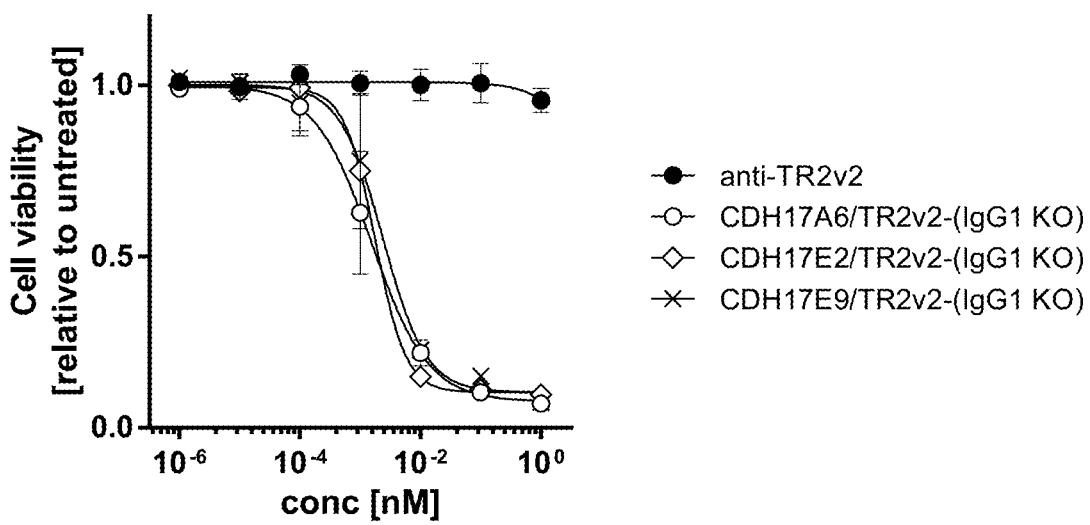
B
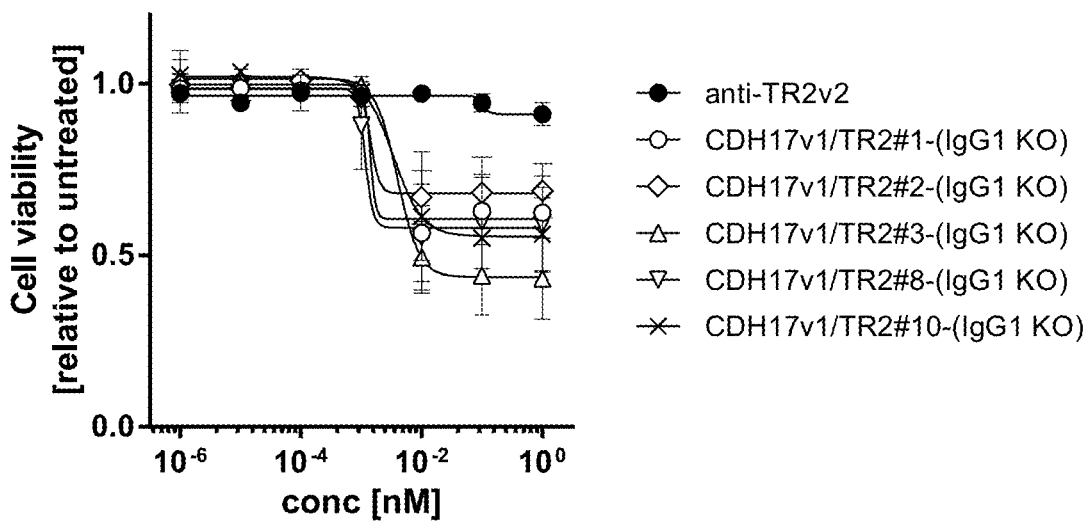

Fig. 9: page 2
C
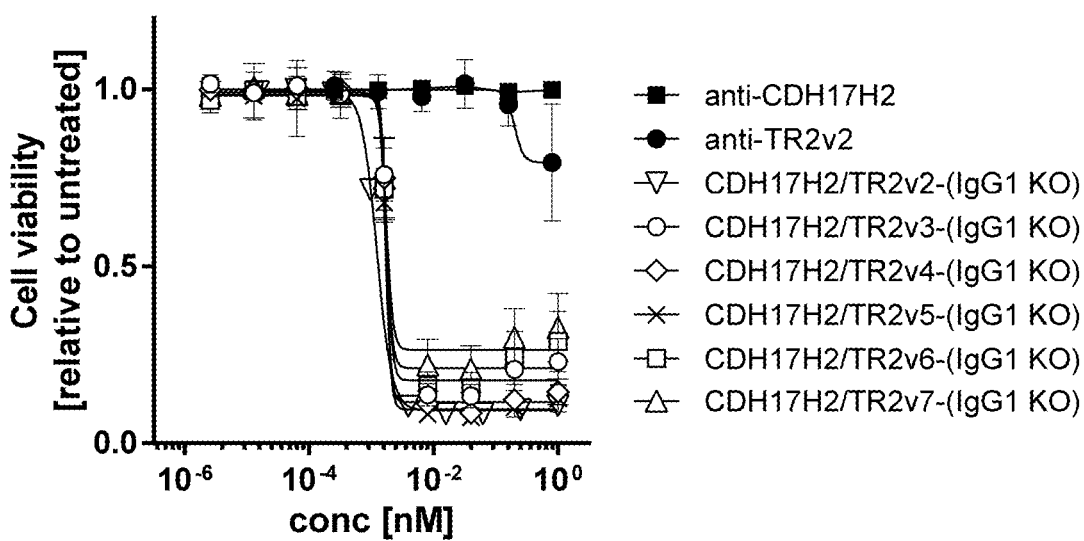
D
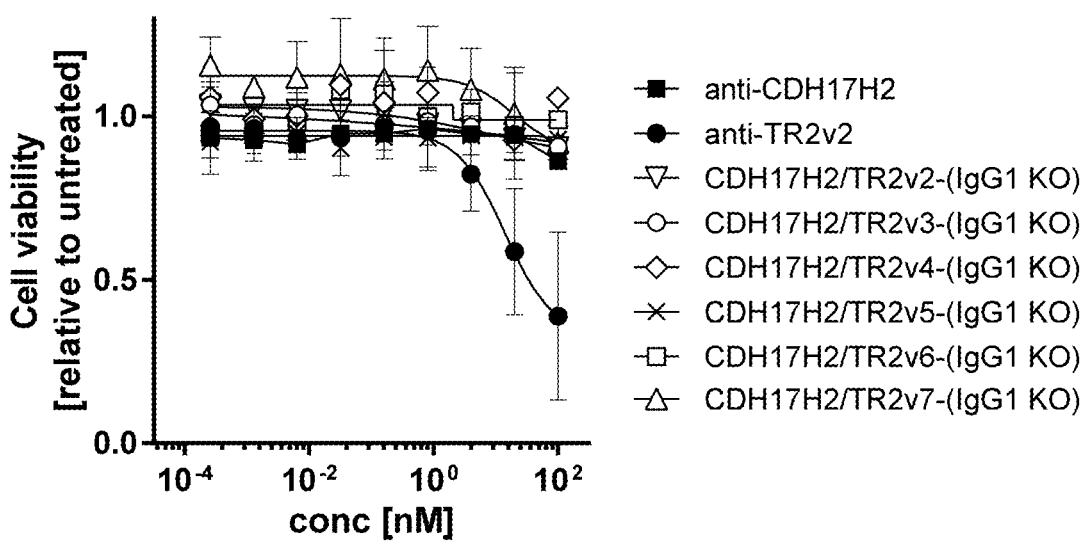

Fig. 10
A
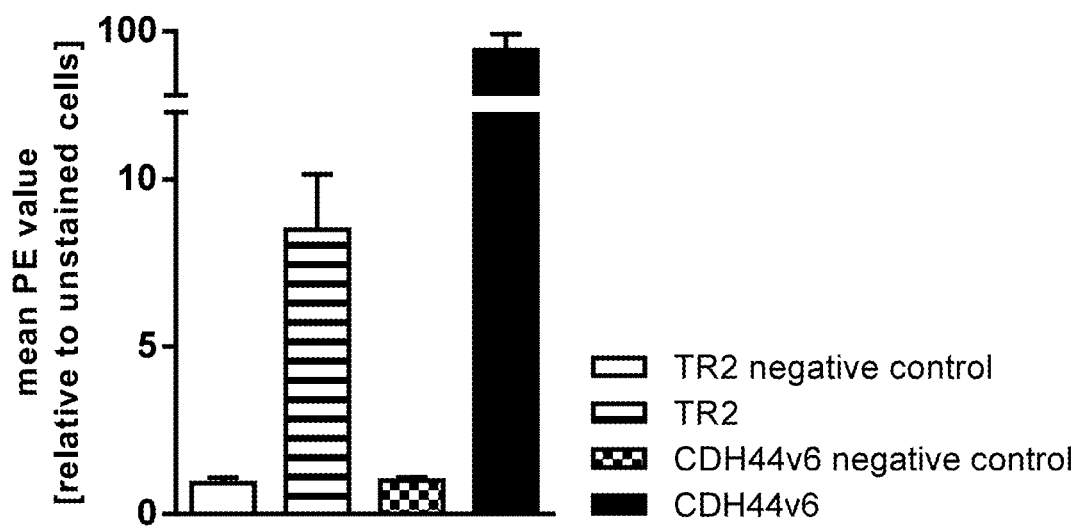
B
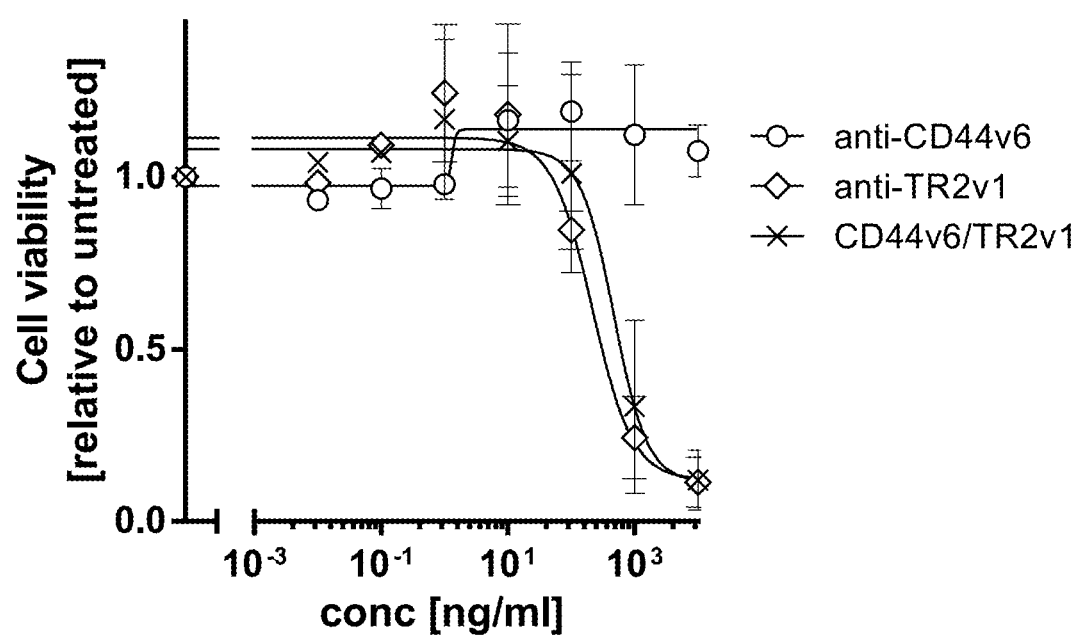

Fig. 11: page 1
A
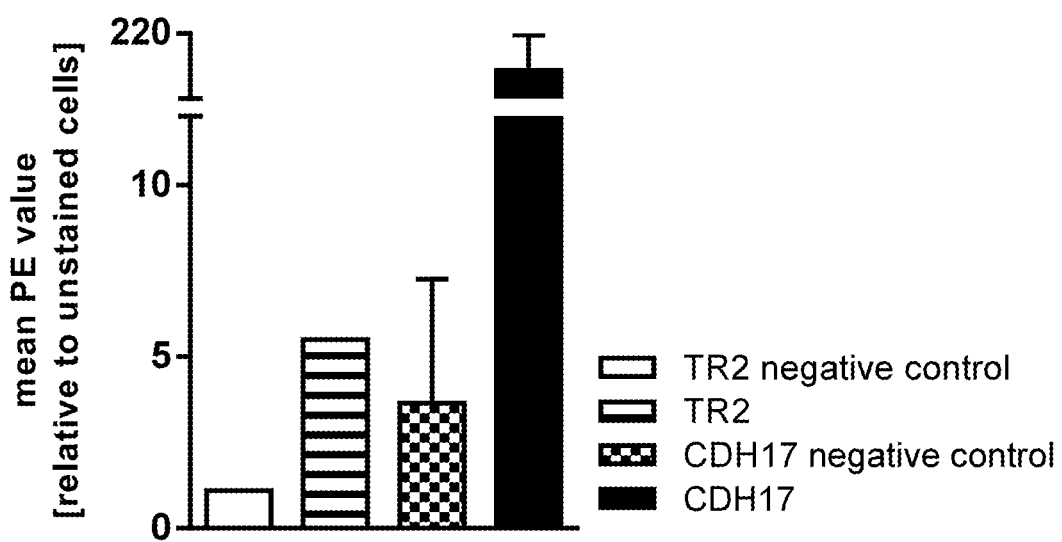
B
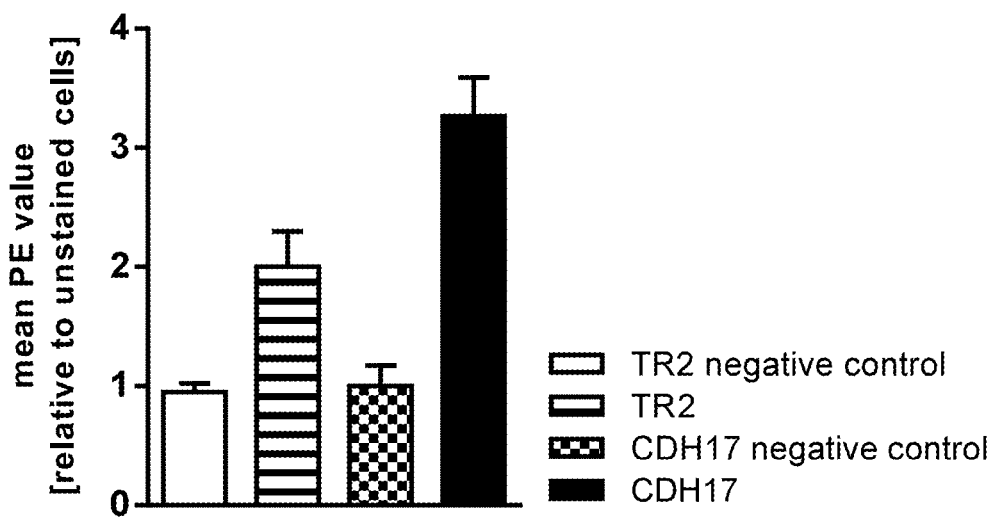

Fig. 11: page 2
C
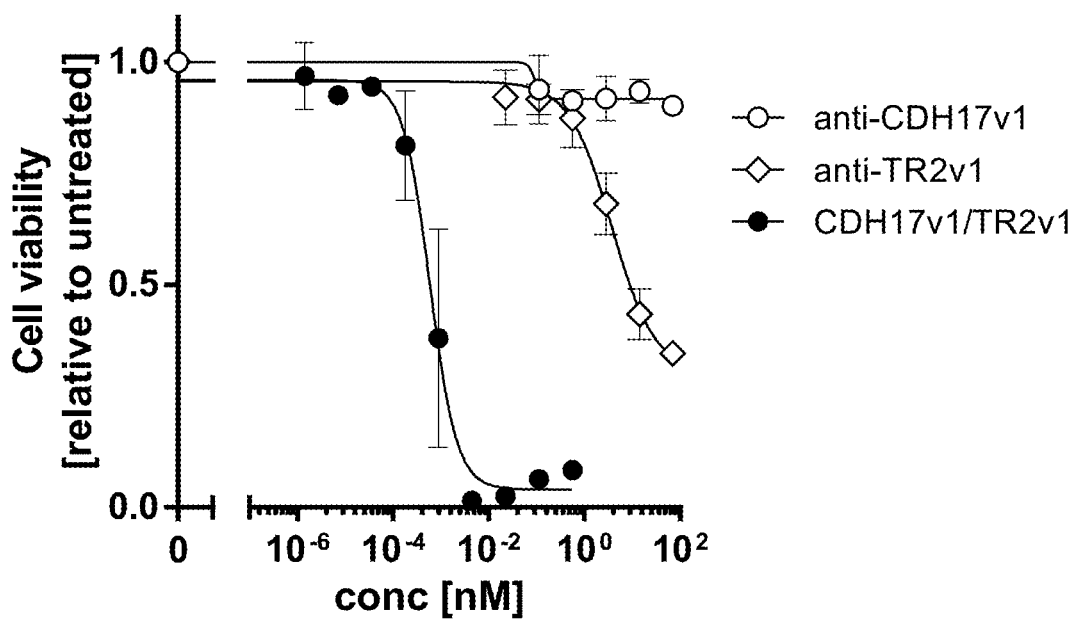
D
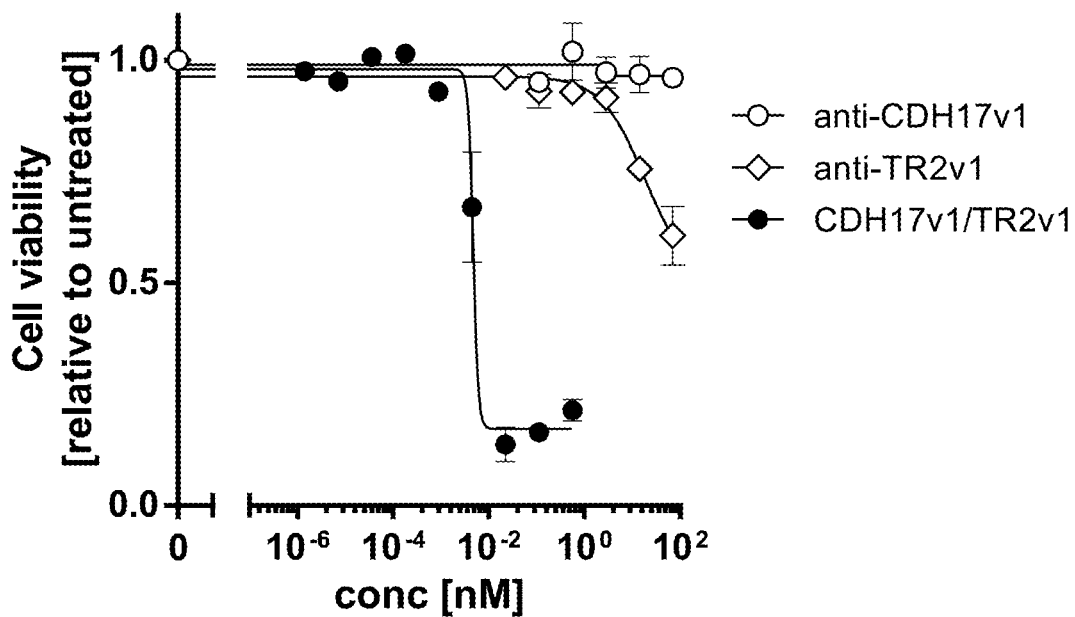

Fig. 12: page 1
A
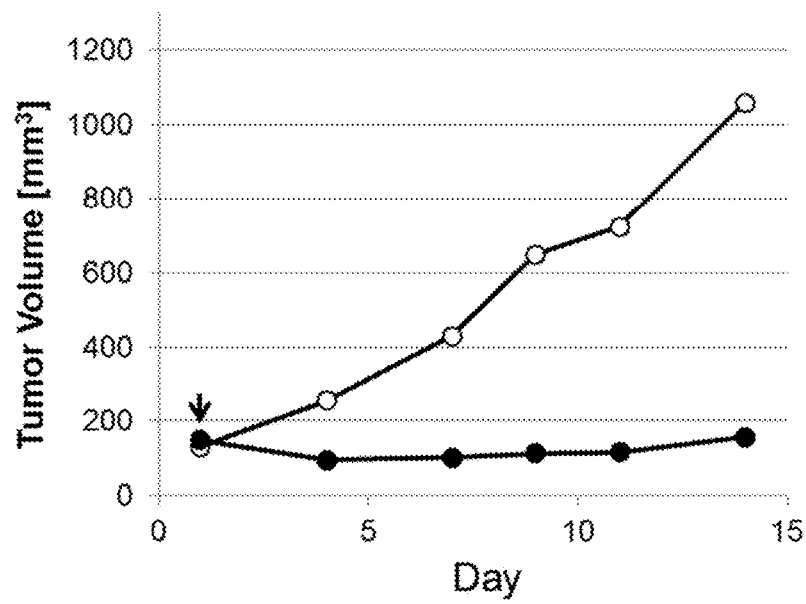
B
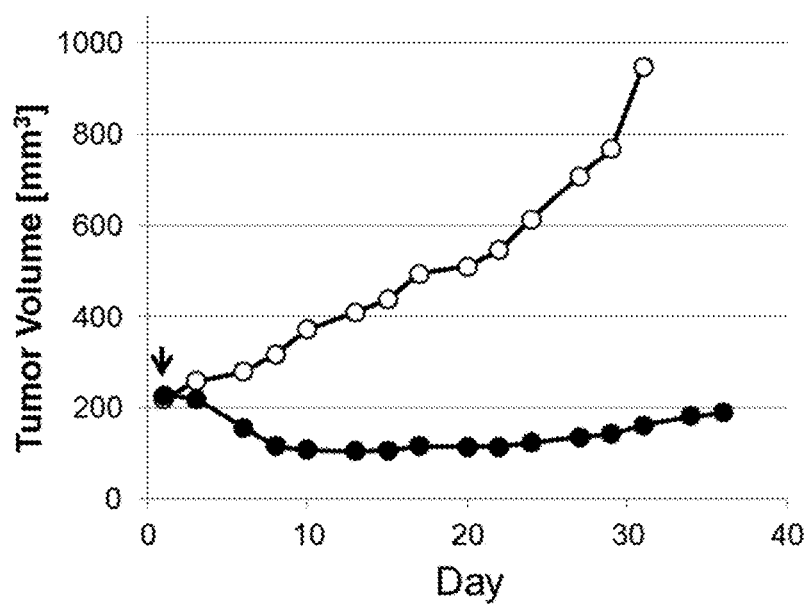

Fig. 12: page 2
C
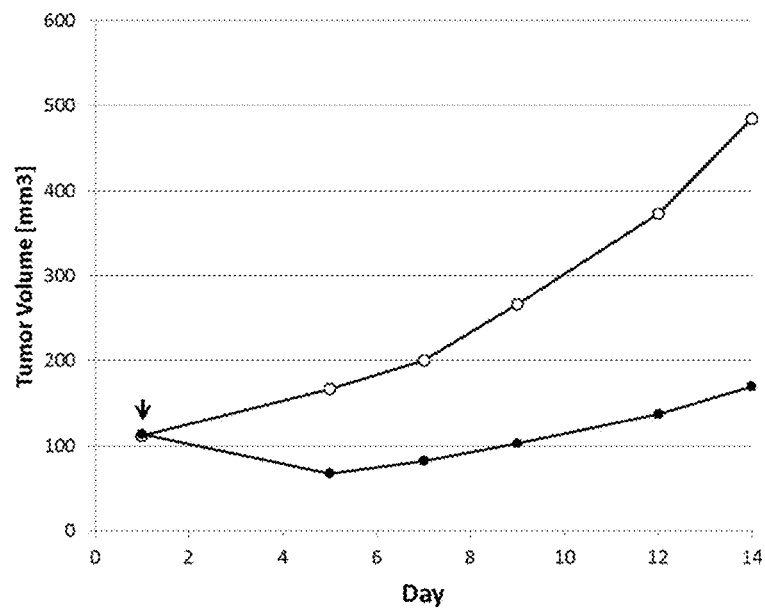
D
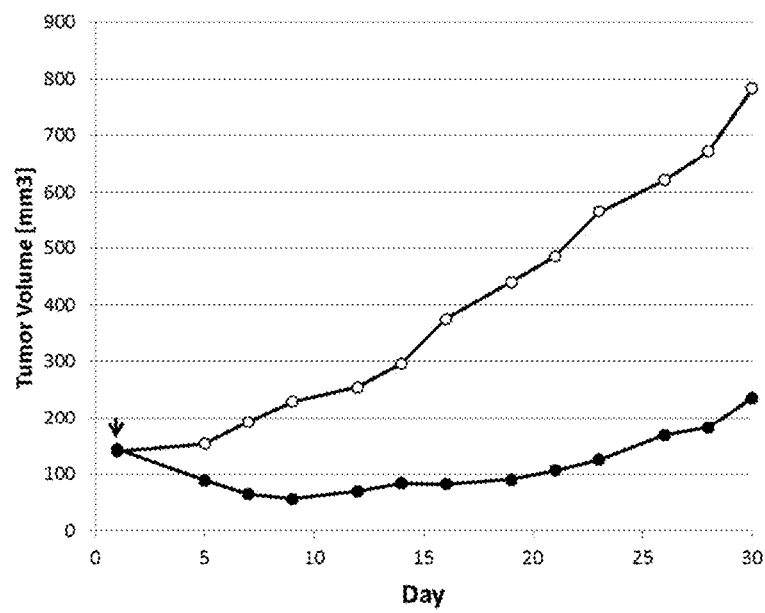

TRAILR2 CDH17 BINDING MOLECULES FOR THE TREATMENT OF CANCER

FIELD OF THE INVENTION

This invention relates to binding molecules that bind to TNF-related apoptosis-inducing ligand receptor 2 (TRAILR2) and cadherin-17 (CDH17) and their use in medicine, pharmaceutical compositions containing the same, and methods of using the same as agents for treatment and/or prevention of cancer.

BACKGROUND OF THE INVENTION

Cancer is a group of diseases commonly based on abnormal cell proliferation and the potential for cancerous cells to invade or spread throughout the body. It is a serious disease and a major cause of death globally.

Various methods of treatment have been used in an attempt to manage or in some cases treat cancer, including surgery, chemotherapy, radiation therapy and hormonal therapy. Although in recent years there have been advances in the treatment of certain cancers, there remains still a need for improvements in the treatment of this disease.

Antibody-based biological molecules offer the potential to be powerful therapeutic agents for the treatment of cancer. Antibodies are designed to recognize and bind to specific proteins on the surface of cells (their target antigens), and such proteins may be present only on the surface of specific cancer cells or on immune cells. This binding can provoke a number of different biological responses, depending on the function of their target antigen protein and also the structure of the antibody itself.

For example, some antibodies trigger the immune system to attack and kill cancer cells, either by attracting immune cells to the cancer cells or by directly influencing the activity of the immune system itself. A further type of antibody-based therapy binds to cancer cells to stop or reduce cell division thus slowing or preventing abnormal cell proliferation. Other types of antibodies have drugs or radioactive particles attached to them and hence deliver these therapeutics to the cancer cell itself.

Apoptosis is a controlled cellular mechanism, where the organism maintains cellular homeostasis in normal tissue compartments and eliminates disordered cells.

There are two major signaling pathways leading to apoptosis in mammalian cells: the intrinsic pathway and the extrinsic pathway. The intrinsic pathway is initiated at the mitochondrial level and plays a substantial role in chemotherapy- or irradiation-induced cell death. By contrast, the extrinsic death pathway is initiated through death receptor-mediated signals on the cell surface.

Cell death induced through the extrinsic pathway has been studied extensively following signals mediated by various members of tumor necrosis factor (TNF) receptor superfamily. The TNF superfamily is characterized by a sequence of two to five cysteine-rich extracellular repeats. The death receptors belonging to the TNF superfamily share a homologous, intracellular death domain of about 80 amino acids, which is essential for the transduction of apoptotic signals.

TNF-related apoptosis-inducing ligand (TRAIL) is a natural protein ligand which interacts with two types of receptors: death receptors triggering- and decoy receptors inhibiting-TRAIL-induced apoptosis. To date, four human receptors specific for TRAIL have been identified: the death receptors, DR4 (DR4/TRAIL receptor 1/TRAILR1) and DR5 (TRAIL receptor 2/TRAIL-R2/KILLER), and the decoy receptors, DcR1/TRAILR3/TRID and DcR2/TRAILR4. TRAIL can also bind to osteoprotegerin (OPG), a soluble decoy receptor, at low affinity.

Targeting the TRAIL receptors has been considered a useful approach in developing cancer therapies, since if an antibody-based molecule can bind to and activate the TRAIL-receptor, i.e. a TRAIL-receptor agonist molecule, then it can induce apoptosis in cancer cells. As shown in many preclinical studies, TRAIL-signaling efficiently induces apoptosis in numerous tumor cell lines but not in the majority of normal cells. However, normal tissues especially hepatocytes in the liver are also reported to be susceptible to this mechanism of apoptosis induction. Hence, if a molecule is used which too efficiently activates the pathway, severe side effects can be induced due to apoptosis induction also in non-cancerous cells. On the other hand, if only weakly activating molecules are used then these have been shown to have poor anticancer activity, although they are well tolerated.

There is hence a need to develop therapeutically efficacious but safe antibody-based biological molecules which can function as TRAIL-receptor agonist molecules. It was thus an object of the present invention to generate TRAIL-receptor agonist molecules having an improved therapeutic profile.

SUMMARY OF THE INVENTION

The present invention is based on the concept of combining an antigen binding site that binds specifically to TNF-related apoptosis-inducing ligand receptor 2 (TRAILR2) with an antigen binding site that binds specifically to cadherin-17 (CDH17) within a single binding molecule. As discussed in more detail below, one advantage of the molecule of the invention is that apoptosis is only promoted in cells that present TRAILR2 and CDH17 on their surface.

Hence, a first aspect of the invention provides a binding molecule having at least one antigen binding site (a first antigen binding site) that binds specifically to TNF-related apoptosis-inducing ligand receptor 2 (TRAILR2) and at least one antigen binding site (a second antigen binding site) that binds specifically to cadherin-17 (CDH17).

In a preferred embodiment of the binding molecule of the invention, the molecule is bispecific and tetravalent.

In a preferred embodiment of the binding molecule of the invention, the at least one antigen binding site that binds specifically to cadherin-17 (CDH17) is an immunoglobulin (Ig) molecule (having the conventional Y shaped structure of a full length antibody with two light and two heavy chains) and the at least one antigen binding site that binds specifically to TNF-related apoptosis-inducing ligand receptor 2 (TRAILR2) comprises one or more scFv(s).

In a preferred embodiment of the binding molecule of the invention, the one or more scFv(s) have a VL-VH orientation from N- to C-terminus.

In a preferred embodiment of the binding molecule of the invention, the one or more scFv(s) is fused to the C-terminus of the heavy chain of the Ig molecule. For example, one scFv is fused to the C-terminus of one of the heavy chains of the Ig molecule and one scFv is fused to the C-terminus is fused to the C-terminus of the other heavy chain of the Ig molecule. As such, an scFv specific for TRAILR2 is fused to each of the heavy chains of the Ig molecule, thereby forming a symmetric, bispecific and tetravalent structure.

In a preferred embodiment of the binding molecule of the invention, the Ig molecule is IgG1KO. In another preferred embodiment of the binding molecule of the invention, the Ig molecule is IgG1FcRnmut.

In a preferred embodiment of the binding molecule of the invention, the one or more scFv(s) is fused to the Ig molecule by a peptide linker, preferably a peptide linker having a length of about 4 to 20 amino acids (e.g., any one of 6, 9, 12, 15 amino acids).

In a preferred embodiment of the binding molecule of the invention, the antigen binding site that binds specifically to TRAILR2 (the first antigen binding site) is selected from the group consisting of antigen binding sites (i) to (xiii):

i) an antigen binding site comprising heavy chain complementary determining regions (CDRs) comprising the amino acid sequences of SEQ ID NO:1 (CDR1), SEQ ID NO.:2 (CDR2) and SEQ ID NO.:3 (CDR3) and light chain CDRs comprising the amino acid sequences of SEQ ID NO.:4 (CDR1), SEQ ID NO.:5 (CDR2) and SEQ ID NO.:6 (CDR3);

ii) an antigen binding site comprising heavy chain CDRs comprising the amino acid sequences of SEQ ID NO.:7 (CDR1), SEQ ID NO.:8 (CDR2) and SEQ ID NO.:9 (CDR3) and light chain CDRs comprising the amino acid sequences of SEQ ID NO.:10 (CDR1), SEQ ID NO.11 (CDR2) and SEQ ID NO.:12 (CDR3);

iii) an antigen binding site comprising heavy chain CDRs comprising the amino acid sequences of SEQ ID NO.: 13 (CDR1), SEQ ID NO.:14 (CDR2) and SEQ ID NO.:15 (CDR3) and light chain CDRs comprising the amino acid sequences of SEQ ID NO.:16 (CDR1), SEQ ID NO.17 (CDR2) and SEQ ID NO.:18 (CDR3);

iv) an antigen binding site comprising heavy chain CDRs comprising the amino acid sequences of SEQ ID NO.: 19 (CDR1), SEQ ID NO.:20 (CDR2) and SEQ ID NO.:21 (CDR3) and light chain CDRs comprising the amino acid sequences of SEQ ID NO.:22 (CDR1), SEQ ID NO.23 (CDR2) and SEQ ID NO.:24 (CDR3);

v) an antigen binding site comprising heavy chain CDRs comprising the amino acid sequences of SEQ ID NO.: 25 (CDR1), SEQ ID NO.:26 (CDR2) and SEQ ID NO.:27 (CDR3) and light chain CDRs comprising the amino acid sequences of SEQ ID NO.:28 (CDR1), SEQ ID NO.29 (CDR2) and SEQ ID NO.:30 (CDR3);

vi) an antigen binding site comprising heavy chain CDRs comprising the amino acid sequences of SEQ ID NO.: 31 (CDR1), SEQ ID NO.:32 (CDR2) and SEQ ID NO.:33 (CDR3) and light chain CDRs comprising the amino acid sequences of SEQ ID NO.:34 (CDR1), SEQ ID NO.35 (CDR2) and SEQ ID NO.:36 (CDR3);

vii) an antigen binding site comprising heavy chain CDRs comprising the amino acid sequences of SEQ ID NO.: 37 (CDR1), SEQ ID NO.:38 (CDR2) and SEQ ID NO.:39 (CDR3) and light chain CDRs comprising the amino acid sequences of SEQ ID NO.:40 (CDR1), SEQ ID NO.41 (CDR2) and SEQ ID NO.:42 (CDR3);

viii) an antigen binding site comprising heavy chain CDRs comprising the amino acid sequence of SEQ ID NO.:43 (CDR1), SEQ ID NO.:44 (CDR2) and SEQ ID NO.:48 (CDR3) and light chain CDRs comprising the amino acid sequences of SEQ ID NO.:49 (CDR1), SEQ ID NO.50 (CDR2) and SEQ ID NO.:54 (CDR3);

ix) an antigen binding site comprising heavy chain CDRs comprising the amino acid sequence of SEQ ID NO.:43 (CDR1), SEQ ID NO.:45 (CDR2) and SEQ ID NO.:48 (CDR3) and light chain CDRs comprising the amino acid sequences of SEQ ID NO.:49 (CDR1), SEQ ID NO.51 (CDR2) and SEQ ID NO.:55 (CDR3);

x) an antigen binding site comprising heavy chain CDRs comprising the amino acid sequence of SEQ ID NO.:43 (CDR1), SEQ ID NO.:45 (CDR2) and SEQ ID NO.:48 (CDR3) and light chain CDRs comprising the amino acid sequences of SEQ ID NO.:49 (CDR1), SEQ ID NO.52 (CDR2) and SEQ ID NO.:56 (CDR3);

xi) an antigen binding site comprising heavy chain CDRs comprising the amino acid sequence of SEQ ID NO.:43 (CDR1), SEQ ID NO.:45 (CDR2) and SEQ ID NO.:48 (CDR3) and light chain CDRs comprising the amino acid sequences of SEQ ID NO.:49 (CDR1), SEQ ID NO.50 (CDR2) and SEQ ID NO.:56 (CDR3);

xii) an antigen binding site comprising heavy chain CDRs comprising the amino acid sequence of SEQ ID NO.:43 (CDR1), SEQ ID NO.:46 (CDR2) and SEQ ID NO.:48 (CDR3) and light chain CDRs comprising the amino acid sequences of SEQ ID NO.:49 (CDR1), SEQ ID NO.51 (CDR2) and SEQ ID NO.:57 (CDR3); and xiii) an antigen binding site comprising heavy chain CDRs comprising the amino acid sequence of SEQ ID NO.:43 (CDR1), SEQ ID NO.:47 (CDR2) and SEQ ID NO.:48 (CDR3) and light chain CDRs comprising the amino acid sequences of SEQ ID NO.:49 (CDR1), SEQ ID NO.53 (CDR2) and SEQ ID NO.:57 (CDR3).

In a preferred embodiment of the binding molecule of the invention, the antigen binding site that binds specifically to TRAILR2 (the first antigen binding site) is selected from the group consisting of antigen binding sites (i) to (xiv):

i) an antigen binding site comprising a heavy chain variable domain comprising the amino acid sequence of SEQ ID NO.:82 and a light chain variable domain comprising the amino acid sequence of SEQ ID NO.: 83;

ii) an antigen binding site comprising a heavy chain variable domain comprising the amino acid sequence of SEQ ID NO.:84 and a light chain variable domain comprising the amino acid sequence of SEQ ID NO.: 85;

iii) an antigen binding site comprising a heavy chain variable domain comprising the amino acid sequence of SEQ ID NO.:86 and a light chain variable domain comprising the amino acid sequence of SEQ ID NO.: 87;

iv) an antigen binding site comprising a heavy chain variable domain comprising the amino acid sequence of SEQ ID NO.:88 and a light chain variable domain comprising the amino acid sequence of SEQ ID NO.: 89;

v) an antigen binding site comprising a heavy chain variable domain comprising the amino acid sequence of SEQ ID NO.:90 and a light chain variable domain comprising the amino acid sequence of SEQ ID NO.: 91;

vi) an antigen binding site comprising a heavy chain variable domain comprising the amino acid sequence of SEQ ID NO.:92 and a light chain variable domain comprising the amino acid sequence of SEQ ID NO.: 93;

vii) an antigen binding site comprising a heavy chain variable domain comprising the amino acid sequence of SEQ ID NO.:94 and a light chain variable domain comprising the amino acid sequence of SEQ ID NO.: 95;

viii) an antigen binding site comprising a heavy chain variable domain comprising the amino acid sequence of SEQ ID NO.:96 and a light chain variable domain comprising the amino acid sequence of SEQ ID NO.: 97;
ix) an antigen binding site comprising a heavy chain variable domain comprising the amino acid sequence of SEQ ID NO.:98 and a light chain variable domain comprising the amino acid sequence of SEQ ID NO.: 99;
x) an antigen binding site comprising a heavy chain variable domain comprising the amino acid sequence of SEQ ID NO.:100 and a light chain variable domain comprising the amino acid sequence of SEQ ID NO.: 101;
xi) an antigen binding site comprising a heavy chain variable domain comprising the amino acid sequence of SEQ ID NO.:102 and a light chain variable domain comprising the amino acid sequence of SEQ ID NO.: 103;
xii) an antigen binding site comprising a heavy chain variable domain comprising the amino acid sequence of SEQ ID NO.:104 and a light chain variable domain comprising the amino acid sequence of SEQ ID NO.: 105;
xiii) an antigen binding site comprising a heavy chain variable domain comprising the amino acid sequence of SEQ ID NO.:106 and a light chain variable domain comprising the amino acid sequence of SEQ ID NO.: 107; and
xiv) an antigen binding site comprising a heavy chain variable domain comprising the amino acid sequence of SEQ ID NO.:108 and a light chain variable domain comprising the amino acid sequence of SEQ ID NO.: 109.

In a preferred embodiment of the binding molecule of the invention, the antigen binding site that binds specifically to CDH17 (the second antigen binding site) is selected from the group consisting of antigen binding sites (i) to (iv):
  i) an antigen binding site comprising heavy chain CDRs comprising the amino acid sequences of SEQ ID NO.: 58 (CDR1), SEQ ID NO.:59 (CDR2) and SEQ ID NO.:60 (CDR3) and light chain CDRs comprising the amino acid sequences of SEQ ID NO.:61 (CDR1), SEQ ID NO.:62 (CDR2) and SEQ ID NO.:63 (CDR3);
  ii) an antigen binding site comprising heavy chain CDRs comprising the amino acid sequences of SEQ ID NO.: 64 (CDR1), SEQ ID NO.:65 (CDR2) and SEQ ID NO.:66 (CDR3) and light chain CDRs comprising the amino acid sequences of SEQ ID NO.:67 (CDR1), SEQ ID NO.68 (CDR2) and SEQ ID NO.:69 (CDR3);
  iii) an antigen binding site comprising heavy chain CDRs comprising the amino acid sequences of SEQ ID NO.: 70 (CDR1), SEQ ID NO.:71 (CDR2) and SEQ ID NO.:72 (CDR3) and light chain CDRs comprising the amino acid sequences of SEQ ID NO.:73 (CDR1), SEQ ID NO.:74 (CDR2) and SEQ ID NO.:75 (CDR3); and
  iv) an antigen binding site comprising heavy chain CDRs comprising the amino acid sequences of SEQ ID NO.: 76 (CDR1), SEQ ID NO.:77 (CDR2) and SEQ ID NO.:78 (CDR3) and light chain CDRs comprising the amino acid sequences of SEQ ID NO.:79 (CDR1), SEQ ID NO.:80 (CDR2) and SEQ ID NO.:81 (CDR3).

In a preferred embodiment of the binding molecule of the invention, the antigen binding site that binds specifically to CDH17 (the second antigen binding site) is selected from the group consisting of antigen binding sites (i) to (v):
  i) an antigen binding site comprising a heavy chain variable domain comprising the amino acid sequence of SEQ ID NO.:110 and a light chain variable domain comprising the amino acid sequence of SEQ ID NO.: 111;
  ii) an antigen binding site comprising a heavy chain variable domain comprising the amino acid sequence of SEQ ID NO.:112 and a light chain variable domain comprising the amino acid sequence of SEQ ID NO.: 113;
  iii) an antigen binding site comprising a heavy chain variable domain comprising the amino acid sequence of SEQ ID NO.:114 and a light chain variable domain comprising the amino acid sequence of SEQ ID NO.: 115;
  iv) an antigen binding site comprising a heavy chain variable domain comprising the amino acid sequence of SEQ ID NO.:116 and a light chain variable domain comprising the amino acid sequence of SEQ ID NO.: 117; and,
  v) an antigen binding site comprising a heavy chain variable domain comprising the amino acid sequence of SEQ ID NO.:118 and a light chain variable domain comprising the amino acid sequence of SEQ ID NO.: 119.

In some embodiments, the heavy chain CDR3 sequence of SEQ ID NO:272 is used instead of the heavy chain CDR3 sequences of SEQ ID NO:78 in the context of the binding molecules of the present invention.

In some embodiments, the binding molecules provided in the various aspects below, which are defined by their heavy chain amino acid sequence (e.g. a modified heavy chain with an scFv fused to the C-terminus of an Ig heavy chain) as well as their light chain amino acid sequences, comprise two heavy chains and two light chains, thereby forming a symmetric tetravalent and bispecific structure.

A further aspect of the invention provides a binding molecule having (i) a heavy chain comprising the amino acid sequence of SEQ ID NO: 159, or a heavy chain comprising the amino acid sequence of SEQ ID NO: 160, or a heavy chain comprising the amino acid sequence of SEQ ID NO: 161, or a heavy chain comprising the amino acid sequence of SEQ ID NO: 162, or a heavy chain comprising the amino acid sequence of SEQ ID NO: 163, or a heavy chain comprising the amino acid sequence of SEQ ID NO: 164, or a heavy chain comprising the amino acid sequence of SEQ ID NO: 165, or a heavy chain comprising the amino acid sequence of SEQ ID NO: 166, or a heavy chain comprising the amino acid sequence of SEQ ID NO: 167, or a heavy chain comprising the amino acid sequence of SEQ ID NO: 168, or a heavy chain comprising the amino acid sequence of SEQ ID NO: 169, or a heavy chain comprising the amino acid sequence of SEQ ID NO: 170, or a heavy chain comprising the amino acid sequence of SEQ ID NO: 171, or a heavy chain comprising the amino acid sequence of SEQ ID NO: 172, and (ii) a light chain comprising the amino acid sequence of SEQ ID NO: 173.

A further aspect of the invention provides a binding molecule having (i) a heavy chain comprising the amino acid sequence of SEQ ID NO: 174, or a heavy chain comprising the amino acid sequence of SEQ ID NO: 175, or a heavy chain comprising the amino acid sequence of SEQ ID NO: 176, or a heavy chain comprising the amino acid sequence of SEQ ID NO: 177, or a heavy chain comprising the amino acid sequence of SEQ ID NO: 178, or a heavy chain comprising the amino acid sequence of SEQ ID NO: 179, or a heavy chain comprising the amino acid sequence of SEQ ID NO: 180, or a heavy chain comprising the amino acid sequence of SEQ ID NO: 181, or a heavy chain comprising the amino acid sequence of SEQ ID NO: 182, or a heavy chain comprising the amino acid sequence of SEQ ID NO: 183, or a heavy chain comprising the amino acid sequence of SEQ ID NO: 184, or a heavy chain comprising the amino acid sequence of SEQ ID NO: 185, or a heavy chain comprising the amino acid sequence of SEQ ID NO: 186, or a heavy chain comprising the amino acid sequence of SEQ ID NO: 187, and (ii) a light chain comprising the amino acid sequence of SEQ ID NO: 188.

In a further aspect provided herein is a binding molecule having (i) a heavy chain comprising the amino acid sequence of SEQ ID NO: 189, or a heavy chain comprising the amino acid sequence of SEQ ID NO: 190, or a heavy chain comprising the amino acid sequence of SEQ ID NO: 191, or a heavy chain comprising the amino acid sequence of SEQ ID NO: 192, or a heavy chain comprising the amino acid sequence of SEQ ID NO: 193, or a heavy chain comprising the amino acid sequence of SEQ ID NO: 194, or a heavy chain comprising the amino acid sequence of SEQ ID NO: 195, or a heavy chain comprising the amino acid sequence of SEQ ID NO. 196, or a heavy chain comprising the amino acid sequence of SEQ ID NO. 197, or a heavy chain comprising the amino acid sequence of SEQ ID NO: 198, or a heavy chain comprising the amino acid sequence of SEQ ID NO: 199, or a heavy chain comprising the amino acid sequence of SEQ ID NO: 200, or a heavy chain comprising the amino acid sequence of SEQ ID NO: 201, or a heavy chain comprising the amino acid sequence of SEQ ID NO: 202, and (ii) a light chain comprising the amino acid sequence of SEQ ID NO: 203.

A further aspect of the invention provides a binding molecule having (i) a heavy chain comprising the amino acid sequence of SEQ ID NO: 204, or a heavy chain comprising the amino acid sequence of SEQ ID NO: 205, or a heavy chain comprising the amino acid sequence of SEQ ID NO: 206, or a heavy chain comprising the amino acid sequence of SEQ ID NO: 207, or a heavy chain comprising the amino acid sequence of SEQ ID NO: 208, or a heavy chain comprising the amino acid sequence of SEQ ID NO: 209, or a heavy chain comprising the amino acid sequence of SEQ ID NO: 210, or a heavy chain comprising the amino acid sequence of SEQ ID NO: 211, or a heavy chain comprising the amino acid sequence of SEQ ID NO: 212, or a heavy chain comprising the amino acid sequence of SEQ ID NO: 213, or a heavy chain comprising the amino acid sequence of SEQ ID NO: 214, or a heavy chain comprising the amino acid sequence of SEQ ID NO: 215, or a heavy chain comprising the amino acid sequence of SEQ ID NO: 216, or a heavy chain comprising the amino acid sequence of SEQ ID NO: 217; or a heavy chain comprising the amino acid sequence of SEQ ID NO: 271 and (ii) a light chain comprising the amino acid sequence of SEQ ID NO: 218.

In a further aspect provided herein is a binding molecule having (i) a heavy chain comprising the amino acid sequence of SEQ ID NO: 145, or a heavy chain comprising the amino acid sequence of SEQ ID NO: 147, or a heavy chain comprising the amino acid sequence of SEQ ID NO: 149, or a heavy chain comprising the amino acid sequence of SEQ ID NO: 151, or a heavy chain comprising the amino acid sequence of SEQ ID NO: 153, or a heavy chain comprising the amino acid sequence of SEQ ID NO: 155, or a heavy chain comprising the amino acid sequence of SEQ ID NO: 157, or a heavy chain comprising the amino acid sequence of SEQ ID NO: 219, or a heavy chain comprising the amino acid sequence of SEQ ID NO: 220, or a heavy chain comprising the amino acid sequence of SEQ ID NO: 221, or a heavy chain comprising the amino acid sequence of SEQ ID NO: 222, or a heavy chain comprising the amino acid sequence of SEQ ID NO: 223, or a heavy chain comprising the amino acid sequence of SEQ ID NO: 224, or a heavy chain comprising the amino acid sequence of SEQ ID NO: 225; or a heavy chain comprising the amino acid sequence of SEQ ID NO: 226, or a heavy chain comprising the amino acid sequence of SEQ ID NO: 227, or a heavy chain comprising the amino acid sequence of SEQ ID NO: 228, or a heavy chain comprising the amino acid sequence of SEQ ID NO: 229, or a heavy chain comprising the amino acid sequence of SEQ ID NO: 230, or a heavy chain comprising the amino acid sequence of SEQ ID NO: 231, or a heavy chain comprising the amino acid sequence of SEQ ID NO: 232 and (ii) a light chain comprising the amino acid sequence of SEQ ID NO: 233.

A further aspect of the invention provides a nucleic acid molecule encoding a binding molecule of the invention or an expression vector containing such a nucleic acid molecule.

A further aspect of the invention provides a host cell comprising a nucleic acid molecule of the invention in functional association with an expression control sequence. Further provided herein is a host cell comprising an expression vector comprising a nucleic acid molecule encoding a binding molecule as described herein.

A further aspect of the invention provides a method of production of a binding molecule of the invention, comprising
 (a) cultivating the host cell of the invention under conditions allowing expression of the molecule; and,
 (b) recovering the molecule.

A further aspect of the invention provides a binding molecule of the invention, for use in medicine.

A further aspect of the invention provides a binding molecule of the invention, for use in the therapy of cancer, preferably colorectal cancer (CRC), gastric cancer (GC), pancreatic cancer (PAC), Esophageal cancer or neuroendocrine tumors.

A further aspect of the invention provides a pharmaceutical composition, comprising a binding molecule of the invention together with a pharmaceutically acceptable carrier and optionally one or more further active ingredients.

A further aspect of the invention provides a method of treatment of cancer comprising administering an effective amount of a binding molecule of the invention to a patient in need thereof.

Further provided herein are antibodies specifically binding to CDH17 comprising (i) heavy chain CDRs comprising the amino acid sequences of SEQ ID NO:58 (CDR1), SEQ ID NO:59 (CDR2) and SEQ ID NO:60 (CDR3) and light chain CDRs comprising the amino acid sequences of SEQ ID NO:61 (CDR1), SEQ ID NO:62 (CDR2) and SEQ ID NO:63 (CDR3), (ii) heavy chain CDRs comprising the amino acid sequences of SEQ ID NO.:64 (CDR1), SEQ ID NO:65 (CDR2) and SEQ ID NO:66 (CDR3) and light chain CDRs comprising the amino acid sequences of SEQ ID NO:67 (CDR1), SEQ ID NO:68 (CDR2) and SEQ ID NO:69 (CDR3), (iii) heavy chain CDRs comprising the amino acid sequences of SEQ ID NO.:70 (CDR1), SEQ ID NO:71 (CDR2) and SEQ ID NO:72 (CDR3) and light chain CDRs comprising the amino acid sequences of SEQ ID NO:73 (CDR1), SEQ ID NO:74 (CDR2) and SEQ ID NO:75 (CDR3), or (iv) heavy chain CDRs comprising the amino acid sequences of SEQ ID NO:76 (CDR1), SEQ ID NO:77 (CDR2) and SEQ ID NO:78 (CDR3) and light chain CDRs comprising the amino acid sequences of SEQ ID NO:79 (CDR1), SEQ ID NO:80 (CDR2) and SEQ ID NO:81 (CDR3).

BRIEF DESCRIPTION OF THE FIGURES

FIG. 4: Analysis of apoptosis induction (caspase activation assay) after antibody incubation. Colo-205 cells were treated for (A) 2 h or (B) 6 h with different concentrations of (i) anti-TRAILR2 (anti-TR2v1) alone, (ii) anti-CDH17v1 alone and (iii) CDH17v1/TR2v1 bispecific molecule. (A) caspase-8 or (B) caspase-3 activation was measured. Data are expressed as mean relative values of the fold change compare to untreated control plus standard deviation. Three independent assays were performed in duplicate for each condition.

FIG. 6: Effect of antibodies incubation on CDH17 negative cells. (A) Analysis of the protein surface expression of TRAILR2 (TR2) and CDH17 in HepG2 cells. Results are shown as the mean PE values relative to the controls samples containing only cells. Data are representative of three independent experiments. (B) HepG2 cells were treated for 72 h with different concentrations of (i) anti-TRAILR2 (anti-TR2v1) alone, (ii) TRAILR2/CDH17 bispecific molecule (CDH17v1/TR2v1), or (iii) anti-TRAILR2 in the presence of cross-linker, goat anti-human IgG (anti-TR2v1 (Fc cross-linking)). The data is expressed as mean relative values compared to untreated control plus standard deviation. Five independent assays were performed in duplicate for each condition.

FIG. 7: Effect of bispecific molecules containing different IgG scaffolds on cell viability. Colo-205 cells were treated for 24 h with different concentrations of anti-TRAILR2 (anti-TR2v1 or anti-TR2v2) alone and different bispecific, tetravalent molecule recognizing human TRAILR2 and human CDH17 containing different IgG1 (A and C) and IgG4Pro (B) scaffolds. Data are expressed as mean relative values compare to untreated control plus standard deviation. Two independent assays were performed in duplicate for each condition.

FIG. 9: Effect bispecific, tetravalent molecules recognizing human TRAILR2 (TR2) and human CDH17 on cell viability. (A-C) Colo-205 cells were treated for 24 h with different concentrations of different bispecific molecules containing different CDH17 binders and scFv variants. (D) HepG2 cells were treated for 72 h with different concentrations of different bispecific molecules containing different CDH17 binders and scFv variants. Anti-TR2v2 (A-D) and anti-CDH17H2 (C-D) antibodies alone were used as controls. Data are expressed as mean relative values compare to untreated control plus standard deviation. At least two independent assays were performed in duplicate for each condition.

FIG. 10: Effect of the bispecific molecule recognizing human TRAILR2 (TR2) and human CD44v6 on cell viability. (A) Analysis of the protein surface expression of TRAILR2 (TR2) and CD44v6 in Colo-205 cells. Results are shown as the mean PE values relative to the controls samples containing only cells. Both proteins showed significant expression compared to the respective IgG controls. Data are representative of 3 independent experiments. (B) Colo-205 cells were treated for 72 h with different concentrations of anti-TRAILR2 (anti-TR2v1) alone, anti-CD44v6 antibody alone and CD44v6/TR2v1 bispecific molecule. Data are expressed as mean relative values compare to untreated control plus standard deviation. Two independent assays were performed in duplicate for each condition.

FIG. 11: Effect of antibodies incubation on CRC cells viability. (A and B) Analysis of the protein surface expression of TRAILR2 (TR2) and CDH17 in CL-34 (A) and SK-CO-1 (B) cells. Results are shown as the mean PE values relative to the controls samples containing only cells plus standard deviation. Data are representative of 2 independent experiments. CL-34 (C) and SK-CO-1 (D) cells were treated for 120 h and 96 h respectively with different concentrations of (i) anti-TRAILR2 (anti-TR2v1) alone, (ii) anti-CDH17v1 alone or (iii) CDH17v1/TR2v1. Data are expressed as mean relative values compare to untreated control plus standard deviation. Two independent assays were performed in duplicate for each condition.

FIG. 12: Efficacy of tetravalent molecule recognizing human TRAILR2 (TR2) and human CDH17: TRAILR2/CDH17 bispecific molecule (represented by closed circles) [CDH17H2/TR2v2-(Ig G1 KO) (A and B) or CDH17H2/TR2v2-(Ig G1 FcRnmut) (C and D)] or vehicle control (represented by open circles) was administered to mice bearing Colo205 (A and C) or Gp2d (B and D) tumor cells. Tumor volume (mm3) was measured after administration on the indicated days and data are expressed as the median of the tumor volumes. 8-10 animals were included on each group.

DETAILED DESCRIPTION OF THE INVENTION

Figure 1A:
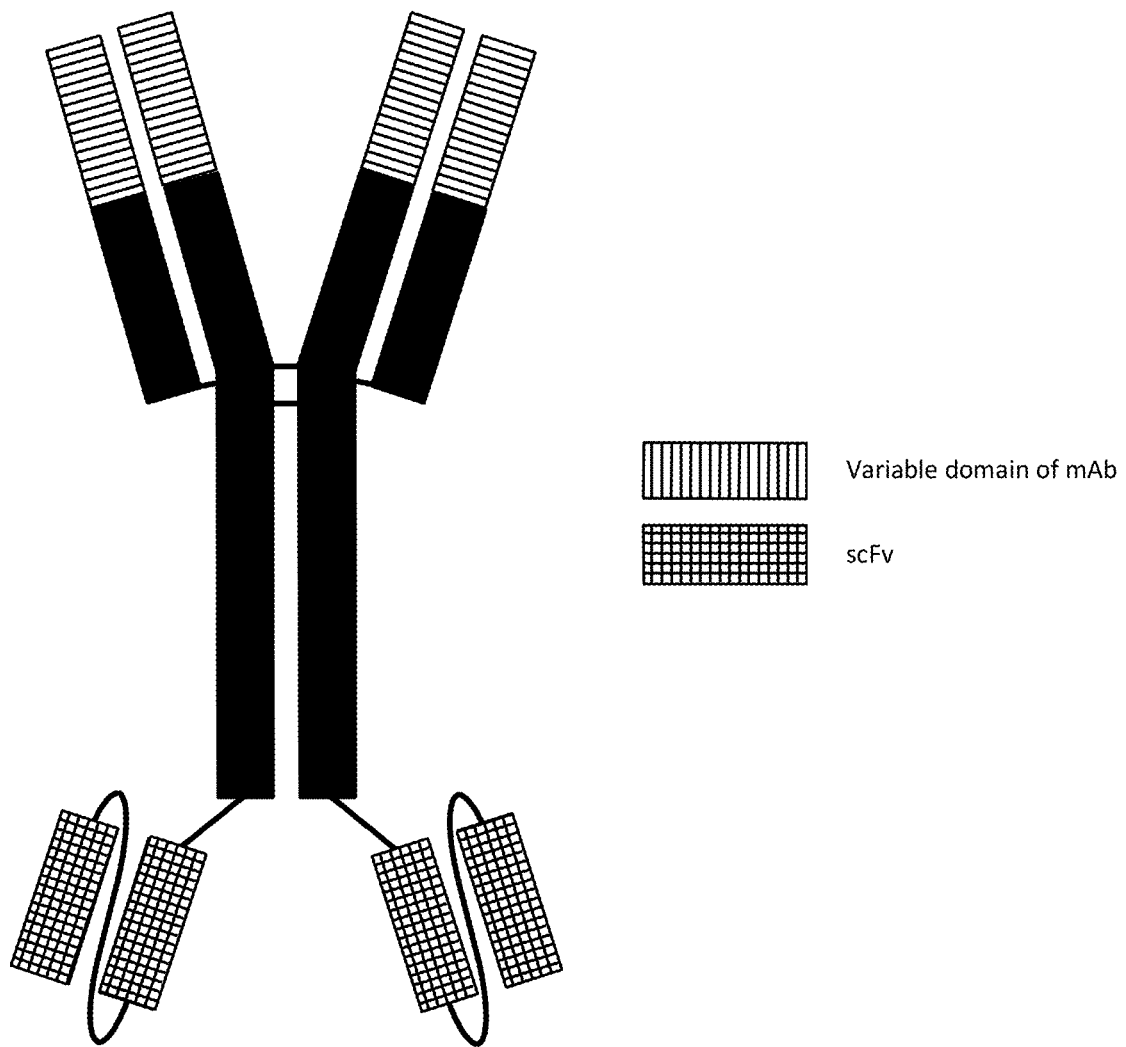
FIGS. 1A and B: Schematic representation of the binding molecule of the invention. An example for a binding molecule of the invention is depicted comprising (i) an Ig molecule specifically binding to CDH17, which comprises two heavy and two light chains, and (ii) two scFv molecules specifically binding to TRAILR2. The N-terminus of an scFv is fused to the C-terminus of each of heavy chains of the Ig molecule, thereby forming a symmetric, bispecific and tetravalent antibody-like molecule.

As described above, one approach to treating cancer has been to induce apoptosis in a cancer cell by using molecules which specifically bind to and activate the TNF-related apoptosis-inducing ligand (TRAIL) receptor-mediated apoptotic pathway. As shown in many preclinical studies, TRAIL-signaling efficiently induces apoptosis in numerous tumor cell lines but not in the majority of normal cells. However, normal tissues especially hepatocytes in the liver are also reported to be susceptible to this mechanism of apoptosis induction. TRAIL binds with high affinity to four distinct cell surface receptors. Two of them, TRAILR1 and TRAILR2, are able to trigger TRAIL-induced apoptosis via the interaction of its intracellular death domain with different adaptor proteins and pro-caspase 8. Clustering of TRAILR1 or TRAILR2 molecules via TRAIL ligand facilitates autocatalytic cleavage and activation of pro-caspase 8 which in turn leads to the induction of apoptosis. TRAILR3 and TRAILR4 are decoy receptors, and while their extracellular domains are able to bind TRAIL, the intracellular portions of the receptors do not contain a domain able to induce apoptosis upon TRAIL binding.

Overexpression of decoy TRAIL receptors can cause the cancer cells to be insensitive to the presence of the TRAIL ligand. The specific targeting of the non-decoy, death-inducing TRAIL receptors avoid this problem and it represents a more effective treatment of tumors. The present invention focuses on developing TRAILR2 agonist molecules. TRAILR2 is widely expressed in a broad spectrum of cancers.

Several TRAILR2 specific agonistic antibodies including Lexatumumab (HGS-ETR2) have been developed for the treatment of cancer. However these agonistic antibodies lacked efficacy in the clinic. This is likely to be due to a lack of sufficient clustering of the TRAILR2 receptor, and hence the failure to effectively induce apoptosis in cancer cells.

In a different attempt to promote TRAILR2-mediated apoptosis in cancer cells, a novel tetrameric TRAILR2-binding nanobody, TAS266, has been developed. In preclinical experiments it demonstrated antitumor efficacy superior to conventional TRAILR2-targeting antibodies. However, it has been reported that hepatocytes in the liver can be sensitive to TRAILR2 mediated apoptosis and therefore a non-targeted increase of TRAILR2 clustering, as promoted by TAS266, has the risk of potential toxicity. Indeed, the Phase I clinical trial of TAS266 has been terminated.

Hence, if a molecule is used which too efficiently agonises the pathway, then severe side effects can be induced since apoptosis is induced in non-cancerous cells. On the other hand, if only weakly agonising molecules are used then these have been shown to have poor anticancer activity, although they are well tolerated.

In the past, attempts have been made to design bispecific molecules consisting of a TRAIL receptor binding site and a site which binds cancer cell specific cell surface molecules, termed an "anchor target". In theory, such bispecific molecules bind exclusively to a cancer cell expressing the anchor target and induce apoptosis through their TRAIL receptor binding site.

A number of different anchor targets have been proposed as being suitable combination partners for TRAIL receptors binding molecule.

For example, CEA (CEAMS_HUMAN) and CRIPTO have been suggested as a suitable anchor targets in WO2011039126A1. CEA and CRIPTO are linked to the cell membrane by a GPI anchor. However, CEA and CRIPTO are both readily cleaved from the cell surface and shed into the bloodstream from tumors. Indeed, CEA serum levels are used as a biomarker for cancer screening. As can be appreciated, serum CEA and CRIPTO can bind to bispecific molecule having dual binding for TRAIL receptor and these anchor targets. Hence serum CEA and CRIPTO will not only compete with membrane bound anchor proteins, but also can increase the likelihood of TRAIL receptor activation in cells not expressing CEA or CRIPTO and hence could cause unwanted side effects.

FAP (Fibroblast activation protein) has also been proposed as an anchor target. However, FAP is only expressed on activated fibroblast cells which are located within the tumor stroma. FAP is not expressed in epithelial cancer cells. Hence a FAP bispecific molecule will only function to promote apoptosis in those cancer cells which are in close physical contact with an activated fibroblast (Brünker et al., Molecular Cancer Therapeutics (2016), 15(5):946-957). Tumor cells that are not in direct contact with an activated fibroblast will not be affected by this treatment and will continue to proliferate. Hence there are clear disadvantages with using FAP as an anchor target to mediate TRAIL receptor-induced apoptosis in cancer cells. In addition, since activated fibroblast cells are also found in sites of tissue remodeling including liver fibrosis, lung fibrosis, artheriosclerosis, and arthritis, a bi-specific molecule targeting FAP and TRAIL receptor could potentially anchor onto the surface of activated fibroblasts and induce apoptosis on neighbouring normal TRAIL-sensitive cells in the liver or other organs.

Similarly, MCSP (melanoma-associated chondroitin sulfate proteoglycan) and ROBO4 (roundabout homolog 4) have been proposed as anchor targets (He Yuan et al., The Journal of Investigative Dermatology (2016), 136(2):541-544; WO2011039126A1). Apart from its expression on the cell surface of melanomas, MCSP is mainly expressed on neovasculature. ROBO4 is specifically expressed in endothelial cells. Both are described at sites of angiogenesis in different tumors types. Hence, as with FAP, and with the only exception of MSCP-expressing melanomas, to be effective a bispecific molecule targeting MCSP or ROBO4 and a TRAIL receptor will only function to promote apoptosis in cancer cells if they are in close physical contact with endothelial cells. This will not be always possible as a tumor rapidly outgrows its blood supply as it grows. Therefore, again, there are disadvantages to using these molecules as anchor targets.

Furthermore, a bispecific antibody targeting TRAILR2 and LTβR (lymphotoxin-beta Receptor) has been reported to be active in inhibiting tumor growth in murine tumor xenograft models at levels comparable to or greater than the combination of the respective parental antibodies (Michaelson et al., mAbs (2009), 1(2):128-141). LTβR signalling in mice has been shown to be critical for liver regeneration, where LTβR is expressed on mature hepatocytes (Anders R. A. et al. J Immunol (2005), 175(2):1295-1300). Similar to FAP, LTβR signaling is broadly activated during chronic liver inflammation in patients with viral and non-viral hepatitis, cholangitis and HCC. In particular, its expression in hepatocytes has been described (Haybaeck J. et al. Cancer Cell (2009), 16(4): 295-308). Targeting LTβR and TRAIL receptor could potentially anchor onto the surface of LTβR-expressing hepatocytes which are sensitive to TRAILR2 activation, and thus may potentially cause liver toxicity.

Finally, TENASCIN C has also been suggested to be a useful anchor target. TENASCIN C is a secreted protein and hence is not anchored to the cell membrane. This represents another example of an indirect mechanism to induce apoptosis in cancer cells. As with MCSP or ROBO4 anchoring strategies, the TENASCIN C moiety must be in proper orientation to the TRAILR2 molecules on the cancer cell membrane for apoptosis to be effected. In addition, TENASCIN C expression is also upregulated in chronic liver disease and treatment with bispecific molecule comprising a TRAIL agonist is expected to worsen the condition.

Hence at the present time there are problems of therapeutically modulating the TRAIL receptor-mediated apoptotic pathway specifically in cancer cells.

The inventors decided therefore to identify anchor proteins which are not present in substantial quantities in the serum and were localized in cancer cells which co-expressed the TRAILR2. Importantly, the inventors chose to select anchor proteins which were not expressed in liver due to the potential liver toxicity described above.

The present inventors identified cadherin-17 as a potentially suitable anchor target that could be used in combination with a TRAIL receptor binding molecule.

Cadherin-17 (CDH17) is a member of the cadherin superfamily, genes encoding calcium-dependent, membrane-associated glycoproteins. The encoded protein is cadherin-like, consisting of an extracellular region, containing 7 cadherin domains, and a transmembrane region but lacking the cytoplasmic domain conserved among the other members of the cadherin-superfamily.

The inventors analysed the expression of CDH17 in non-neoplastic tissues. IHC studies revealed homogeneous epithelial staining of CDH17 in the mucosal epithelium of small intestine and colon. Heterogeneous epithelial staining was also detected in gall bladder, stomach and the epithelium of intra-pancreatic ducts.

Until the present time no representative studies have been published revealing the co-expression of TRAILR2 and CDH17 in tumors. A high prevalence was shown consistently for the expression of CDH17 (88-100%) as well as for TRAILR2 (87-100%) in CRC. In GC, CDH17 was also demonstrated in 56-90% of all cases, with significantly higher frequency in intestinal types compared to diffuse types, while TRAILR2 has been shown to be constitutively expressed at high levels in primary and metastatic gastric carcinomas. In PAC, CDH17 expression could be shown in 50-82% of all cases and TRAILR2 in 81% (Gallmeier et al., PLoS One. 2013; 8(2):e56760; Ito et al., Virchows Arch. 2005 October; 447(4):717-22; Koornstra et al., Eur J Cancer. 2005 May; 41(8):1195-202; Koyama et al., J Cancer Res Clin Oncol. 2002 February; 128(2):73-9; Luque-Garcia et al., Proteomics. 2010 March; 10(5):940-52; Panarelli et al., Am J Clin Pathol. 2012 August; 138(2):211-22; Su et al., Mod Pathol. 2008 November; 21(11):1379-86; Takamura et al., Cancer Sci. 2003 May; 94(5):425-30; van Geelen et al., J Clin Oncol. 2006 Nov. 1; 24(31):4998-5004.).

Hence the inventors performed this study and showed that TRAILR2 and CDH17 are co-expressed in a variety of tumors (i.e., colorectal cancer (CRC), gastric cancer (GC) and pancreatic cancer (PAC)), with little or no co-expression in non-cancerous cells. Notably, CDH17 was not detectable in normal liver tissue or hepatocytes with reported sensitivity to TRAILR2 activation.

It is important to point out that until the present invention it had not been disclosed or even remotely contemplated to prepare binding molecules targeting these two antigens.

Accordingly, the inventors prepared binding molecules including at least one antigen binding site that binds specifically to TRAILR2 and at least one antigen binding site that binds specifically to CDH17.

In the accompanying experimental data, it can be seen that such molecules are able to induce apoptosis in vitro in cells where both CDH17 and TRAILR2 are expressed, and at therapeutically acceptable amount of the molecule of the invention. Importantly, as shown in the examples, the same molecules induce essentially no apoptosis in cells expressing TRAILR2 but not CDH17. Hence the binding molecules of the present invention have the potential to be therapeutically effective for cancers in which the cancer cells express both CDH17 and TRAILR2. In one aspect, the binding molecules of the present invention do not affect CDH17 negative liver cells, thereby reducing the risk of liver toxicity. Furthermore, the binding molecules of the invention (e.g. binding molecules with (i) two heavy chains each comprising a heavy chain variable region specific for CDH17, constant IgG domains and an scFv specific for TRAILR2 and (ii) two light chains each comprising a light chain variable region specific for CDH17) are shown to be stable with a monomer content above 95%, further supporting their therapeutic applicability.

Hence the CDH17/TRAILR2 binding molecules of the invention have clear advantages over those known molecules in the art and offers utility to treat cancer, including colorectal cancers (CRC), gastric cancers (GC) and pancreatic cancers (PAC).

Furthermore, the ability of CDH17 to potentiate the agonistic effect of the TRAIL receptor binding molecule to TRAILR2 is not common to all cell surface proteins. This is known since the inventors investigated whether CD44v6 could also be a suitable anchor target. CD44v6 is splice variant of the ubiquitously expressed surface glycoprotein CD44, and is known to be a tumor associated antigen with a preferential expression pattern in tumor over normal tissues. However, as shown in the accompanying Examples, CD44v6 does not function as an anchor protein since it does not potentiate the agonistic effect of the TRAIL receptor binding molecule. Therefore the utility of CDH17 as an anchor target is not predictable simply based on the expression profile of the protein.

The first aspect of the invention provides a binding molecule having at least one antigen binding site (a first antigen binding site) that binds specifically to TNF-related apoptosis-inducing ligand receptor 2 (TRAILR2) and at least one antigen binding site (a second antigen binding site) that binds specifically to cadherin-17 (CDH17).

As stated above, until the present invention it had not been disclosed or even remotely contemplated to prepare binding molecules which can specifically bind to TRAILR2 and CDH17. Nonetheless individually each protein and their associated genes are known in the art and are well represented in biological databases.

"For the avoidance of doubt, by "TNF-related apoptosis-inducing ligand receptor 2 (TRAILR2)" we mean the human protein provided in UniProt O14763 www.uniprot.org/uniprot/O14763, and the nucleic acid sequence encoding that protein."

"For the avoidance of doubt, by "cadherin-17 (CDH17)" we mean the human protein provided in UniProt Q12864 www.uniprot.org/uniprot/Q12864, and the nucleic acid sequence encoding that protein."

The present invention relates to binding molecules that have binding specificities for at least two different targets. In relation to the present invention, the binding molecules are derived from antibodies. Techniques for making binding molecules include, but are not limited to, recombinant co-expression of two immunoglobulin heavy chain-light chain pairs having different specificities (see Milstein and Cuello, Nature 305: 537 (1983)), WO 93/08829, and Traunecker et al., EMBO J. 10: 3655 (1991)), and "knob-in-hole" engineering (see, e.g., U.S. Pat. No. 5,731,168). Binding molecules of the invention may also be made by engineering electrostatic steering effects for making antibody Fc-heterodimeric molecules (WO 2009/089004A1); cross-linking two or more antibodies or fragments (see, e.g., U.S. Pat. No. 4,676,980, and Brennan et al., Science, 229: 81 (1985)); using leucine zippers to produce bi-specific antibodies (see, e.g., Kostelny et al., Immunol., 148(5): 1547-1553 (1992)); using "diabody" technology for making bispecific antibody fragments (see, e.g., Hollinger et al., Proc. Natl. Acad. Sci. USA, 90:6444-6448 (1993)); and using single-chain Fv (sFv) dimers (see, e.g. Gruber et al., /. Immunol., 152:5368 (1994)); and preparing trispecific antibodies as described, e.g., in Tutt et al. /. Immunol. 147: 60 (1991).

Terms not specifically defined herein should be given the meanings that would be given to them by one of skill in the art in light of the disclosure and the context. As used in the specification, however, unless specified to the contrary, the following terms have the meaning indicated and the following conventions are adhered to.

As used herein the term "antigen binding site" comprises a heavy chain variable domain ($V_H$) and a light chain variable domain ($V_L$) derived from an antibody. In such case, each variable domain comprises 3 CDRs. In one aspect, an antigen binding site according to the present invention or certain portions of the protein is generally derived from an antibody. The generalized structure of antibodies or immunoglobulin molecules is well known to those of skill in the art.

"Antibodies" or "immunoglobulin molecules" (also known as immunoglobulins, abbreviated Ig) are gamma globulin proteins that can be found in blood or other bodily fluids of vertebrates, and are used by the immune system to identify and neutralize foreign objects, such as bacteria and viruses. They are typically made of basic structural units—each with two large heavy chains and two small light chains—to form, for example, monomers with one unit, dimers with two units or pentamers with five units. Antibodies can bind, by non-covalent interaction, to other molecules or structures known as antigens. This binding is specific in the sense that an antibody will only bind to a specific structure with high affinity. The unique part of the antigen recognized by an antibody is called an epitope, or antigenic determinant. The part of the antibody binding to the epitope is sometimes called paratope and resides in the so-called variable domain, or variable region (Fv) of the antibody. The variable domain comprises three so-called complementary-determining region (CDR's) spaced apart by framework regions (FR's).

Within the context of this invention, reference to CDR's is based on the definition of CCG, also referred to as IMGT (Lefranc M P, Pommié C, Ruiz M, Giudicelli V, Foulquier E, Truong L, Thouvenin-Contet V, Lefranc G. "IMGT unique numbering for immunoglobulin and T cell receptor variable domains and Ig superfamily V-like domains." Dev Comp Immunol. 2003 January; 27(1):55-77; Giudicelli V, Brochet X, Lefranc M P. "IMGT/V-QUEST: IMGT standardized analysis of the immunoglobulin (IG) and T cell receptor (TR) nucleotide sequences". Cold Spring Harb Protoc. 2011; 2011(6):695-715. An alternative definition of CDRs is based on Chothia (Chothia and Lesk, J. Mol. Biol. 1987, 196: 901-917), together with Kabat (E. A. Kabat, T. T. Wu, H. Bilofsky, M. Reid-Miller and H. Perry, Sequence of Proteins of Immunological Interest, National Institutes of Health, Bethesda (1983)).

The expressions "variable domains" or "variable region" or Fv as used herein denotes each of the pair of light and heavy chains which is involved directly in binding the antibody to the antigen. The variable domain of a light chain is abbreviated as "VL" and the variable domain of a heavy chain is abbreviated as "VH". The variable light and heavy chain domains have the same general structure and each domain comprises four framework (FR) regions whose sequences are widely conserved, connected by three HVRs (or CDRs). The framework regions adopt a beta-sheet conformation and the CDRs may form loops connecting the beta-sheet structure. The CDRs in each chain are held in their three-dimensional structure by the framework regions and form together with the CDRs from the other chain the antigen binding site. The antibody's heavy and light chain CDR3 regions play a particularly important role in the binding specificity/affinity of the antibodies according to the invention and therefore provide a further object of the invention. The term "constant domains" or "constant region" as used within the current application denotes the sum of the domains of an antibody other than the variable region. Such constant domains and regions are well known in the state of the art and e.g. described by Kabat et al. ("Sequence of proteins of immunological interest", US Public Health Services, NIH Bethesda, Md., Publication No. 91).

The "Fc part" of an antibody is not involved directly in binding of an antibody to an antigen, but exhibit various effector functions. An "Fc part of an antibody" is a term well known to the skilled artisan and defined on the basis of papain cleavage of antibodies. Depending on the amino acid sequence of the constant region of their heavy chains, antibodies or immunoglobulins are divided in the classes: IgA, IgD, IgE, IgG and IgM. According to the heavy chain constant regions the different classes of immunoglobulins are called α, δ, ε, γ, and µ respectively. Several of these may be further divided into subclasses (isotypes), e.g. IgG1, IgG2, IgG3, and IgG4, IgA1, and IgA2. The Fc part of an antibody is directly involved in ADCC (antibody dependent cell-mediated cytotoxicity) and CDC (complement-dependent cytotoxicity) based on complement activation, C1q binding and Fc receptor binding. Complement activation (CDC) is initiated by binding of complement factor C1q to the Fc part of most IgG antibody subclasses. While the influence of an antibody on the complement system is dependent on certain conditions, binding to C1q is caused by defined binding sites in the Fc part. Such binding sites are known in the state of the art and described e.g. by Boakle et al., Nature 282 (1975) 742-743, Lukas et al., J. Immunol. 127 (1981) 2555-2560, Brunhouse and Cebra, Mol. Immunol. 16 (1979) 907-917, Burton et al., Nature 288 (1980) 338-344, Thommesen et al., Mol. Immunol. 37 (2000) 995-1004, Idusogie et al., J. Immunol. 164 (2000) 4178-4184, Hezareh et al., J. Virology 75 (2001) 12161-12168, Morgan et al., Immunology 86 (1995) 319-324, EP 0307434. Such binding sites are e.g. L234, L235, D270, N297, E318, K320, K322, P331 and P329 (numbering according to EU index of Kabat, see below). Most crucial among these residues in mediating C1q and Fcgamma receptor binding in IgG1 are L234 and L235 (Hezareh et al., J. Virology 75

(2001) 12161-12168). Antibodies of subclass IgG1 and IgG3 usually show complement activation and C1q and C3 binding, whereas IgG2 and IgG4 do not activate the complement system and do not bind C1q and C3.

The art has further developed antibodies and made them versatile tools in medicine and technology. Thus, in the context of the present invention the terms "antibody molecule" or "antibody" (used synonymously herein) do not only include antibodies as they may be found in nature, comprising e.g. two light chains and two heavy chains, or just two heavy chains as in camelid species, but furthermore encompasses all molecules comprising at least one paratope with binding specificity to an antigen and structural similarity to a variable domain of an immunoglobulin.

Thus, an antibody may comprise a monoclonal antibody, a human antibody, a humanized antibody, a chimeric antibody, a fragment of an antibody, in particular a Fv, Fab, Fab', or F(ab')2 fragment, a single chain antibody, in particular a single chain variable fragment (scFv), a Small Modular Immunopharmaceutical (SMIP), a domain antibody, a nanobody, a diabody. The antibody may have an effector function, such as ADCC or CDC, that is usually mediated by the Fc part (antibody constant region) of the antibody, or it may have no effector function, e.g. by lacking a Fc part or having a blocked, masked Fc part, in essence a Fc part that is not or insufficiently recognized by immune cells or immune system components, like the complement system. Monoclonal antibodies (mAb) are monospecific antibodies that are identical in amino acid sequence. They may be produced by hybridoma technology from a hybrid cell line (called hybridoma) representing a clone of a fusion of a specific antibody-producing B cell with a myeloma (B cell cancer) cell (Kohler G, Milstein C. Continuous cultures of fused cells secreting antibody of predefined specificity. Nature 1975; 256:495-7.). Alternatively, monoclonal antibodies may be produced by recombinant expression in host cells (Norderhaug L, Olafsen T, Michaelsen T E, Sandlie I. (May 1997). "Versatile vectors for transient and stable expression of recombinant antibody molecules in mammalian cells." J Immunol Methods 204 (1): 77-87; see also below). A "recombinant antibody" or "recombinant binding molecule" is an antibody or binding molecule which has been produced by a recombinantly engineered host cell. It is optionally isolated or purified.

For application in man, it is often desirable to reduce immunogenicity of antibodies originally derived from other species, like mouse. This can be done by construction of chimeric antibodies, or by a process called "humanization". In this context, a "chimeric antibody" is understood to be antibody comprising a sequence part (e.g. a variable domain) derived from one species (e.g. mouse) fused to a sequence part (e.g. the constant domains) derived from a different species (e.g. human). A "humanized antibody" is an antibody comprising a variable domain originally derived from a non-human species, wherein certain amino acids have been mutated to make the overall sequence of that variable domain more closely resemble to a sequence of a human variable domain. Methods of chimerisation and humanization of antibodies are well-known in the art (Billetta R, Lobuglio A F. "Chimeric antibodies". Int Rev Immunol. 1993; 10(2-3):165-76; Riechmann L, Clark M, Waldmann H, Winter G (1988). "Reshaping human antibodies for therapy". Nature: 332:323).

A "humanized" antibody refers to an antibody comprising amino acid residues from non-human hypervariable regions (HVRs) and amino acid residues from human FRs. In certain embodiments, a humanized antibody will comprise substantially all of at least one, and typically two, variable domains, in which all or substantially all of the HVRs (e.g. complementary determining regions (CDRs)) correspond to those of a non-human antibody, and all or substantially all of the entire framework regions (FRs) correspond to those of a human antibody. A humanized antibody optionally may comprise at least a portion of an antibody constant region derived from a human antibody. A "humanized form" of an antibody, e.g. a non-human antibody, refers to an antibody that has undergone humanization.

Furthermore, technologies have been developed for creating antibodies based on sequences derived from the human genome, for example by phage display or use of transgenic animals (WO 90/05144; D. Marks, H. R. Hoogenboom, T. P. Bonnert, J. McCafferty, A. D. Griffiths and G. Winter (1991) "By-passing immunisation. Human antibodies from V-gene libraries displayed on phage." J. Mol. Biol., 222, 581-597; Knappik et al., J. Mol. Biol. 296: 57-86, 2000; S. Carmen and L. Jermutus, "Concepts in antibody phage display". Briefings in Functional Genomics and Proteomics 2002 1(2):189-203; Lonberg N, Huszar D. "Human antibodies from transgenic mice". Int Rev Immunol. 1995; 13(1):65-93; Bruggemann M, Taussig M J. "Production of human antibody repertoires in transgenic mice". Curr Opin Biotechnol. 1997 August; 8(4):455-8.). Such antibodies are "human antibodies" in the context of the present invention.

Antibody can also include fragments of immunoglobulins which retain antigen binding properties, like Fab, Fab', or F(ab')2 fragments. Such fragments may be obtained by fragmentation of immunoglobulins e.g. by proteolytic digestion, or by recombinant expression of such fragments. For example, immunoglobulin digestion can be accomplished by means of routine techniques, e.g. using papain or pepsin (WO 94/29348). Papain digestion of antibodies typically produces two identical antigen binding fragments, so-called Fab fragments, each with a single antigen binding site, and a residual Fc fragment. Pepsin treatment yields an F(ab')2. In Fab molecules, the variable domains are each fused to an immunoglobulin constant domain, preferably of human origin. Thus, the heavy chain variable domain may be fused to a CH1 domain (a so-called Fd fragment), and the light chain variable domain may be fused to a CL domain. Fab molecules may be produced by recombinant expression of respective nucleic acids in host cells, see below.

A number of technologies have been developed for placing variable domains of immunoglobulins, or molecules derived from such variable domains, in a different molecular context. Those should be also considered as "antibodies" in accordance with the present invention. In general, these antibody molecules are smaller in size compared to immunoglobulins, and may comprise a single amino acid chain or several amino acid chains. For example, a single-chain variable fragment (scFv) is a fusion of the variable regions of the heavy and light chains of immunoglobulins, linked together with a short linker, usually serine (S) or glycine (G) (WO 88/01649; WO 91/17271; Huston et al; International Reviews of Immunology, Volume 10, 1993, 195-217). "Single domain antibodies" or "nanobodies" harbour an antigen-binding site in a single Ig-like domain (WO 94/04678; WO 03/050531, Ward et al., Nature. 1989 Oct. 12; 341(6242):544-6; Revets et al., Expert Opin Biol Ther. 5(1):111-24, 2005). One or more single domain antibodies with binding specificity for the same or a different antigen may be linked together. Diabodies are bivalent antibody molecules consisting of two amino acid chains comprising two variable domains (WO 94/13804, Holliger et al., Proc Natl Acad Sci USA. 1993 Jul. 15; 90(14):6444-8). Other examples of antibody-like molecules are immunoglobulin super family antibodies (IgSF; Srinivasan and Roeske, Current Protein Pept. Sci. 2005, 6(2): 185-96). A different concept leads to the so-called Small Modular Immunopharmaceutical (SMIP) which comprises a Fv domain linked to single-chain hinge and effector domains devoid of the constant domain CH1 (WO 02/056910).

In respect of the present invention, the first aspect of the invention provides a binding molecule comprising at least one antigen binding site that binds specifically to TNF-related apoptosis-inducing ligand receptor 2 (TRAILR2) and at least one antigen binding site that binds specifically to cadherin-17 (CDH17).

As used herein, the term "binding" or "specifically binding" refers to the binding of an antibody or antigen binding site (e.g., in the binding molecule described herein) to an epitope of the antigen in an in-vitro assay. Affinity is the interaction between a single antigen-binding site on an antibody molecule and a single epitope. It is expressed by the equilibrium association constant $Ka=k_{on}/k_{off}$, or the equilibrium dissociation constant $Kd=k_{off}/k_{on}$.

An epitope is a region of an antigen that is bound by an antibody or antigen binding moiety. The term "epitope" includes any polypeptide determinant capable of specific binding to an antibody or antigen binding moiety. In certain embodiments, epitope determinants include chemically active surface groupings of molecules such as amino acids, glycan side chains, phosphoryl, or sulfonyl, and, in certain embodiments, may have specific three dimensional structural characteristics, and/or specific charge characteristics. Conformational and non-conformational epitopes are distinguished in that the binding to the former but not the latter is lost in the presence of denaturing solvents. As used herein, the terms "binding" and "specific binding" refer to the binding of the antibody or antigen binding moiety to an epitope of the antigen in an in vitro assay, preferably in a plasmon resonance assay (BIAcore®, GE-Healthcare Uppsala, Sweden) with purified wild-type antigen.

In one aspect, the binding molecule of the present invention binds to the TRAILR2 or CDH17 target antigens with an affinity, as determined e.g. by surface plasmon resonance analysis (Malmqvist M., "Surface plasmon resonance for detection and measurement of antibody-antigen affinity and kinetics.", Curr Opin Immunol. 1993 April; 5(2):282-6.), with a KD value ranging from 1 pM to 100 µM, preferably 1 pM to 1 µM. Antibody affinity can also be measured using kinetic exclusion assay (KinExA) technology (Darling, R. J., and Brault P-A., "Kinetic exclusion assay technology: Characterization of Molecular Interactions." ASSAY and Drug Development Technologies. 2004, December 2(6): 647-657).

The binding affinity of an antibody molecule may be enhanced by a process known as affinity maturation (Marks et al., 1992, Biotechnology 10:779-783; Barbas, et al., 1994, Proc. Nat. Acad. Sci, USA 91:3809-3813; Shier et al., 1995, Gene 169:147-155). Affinity matured antibodies are therefore also embraced in the present invention.

As used herein, the term "binding" or "specifically binding" refers to the binding of the antibody to an epitope of the antigen in an in-vitro assay, preferably in a surface plasmon resonance assay (SPR, BIAcore, GE-Healthcare Uppsala, Sweden). The affinity of the binding is defined by the terms $k_{on}$ (rate constant for the association of the antibody from the antibody/antigen complex), $k_{off}$ (dissociation constant), and KD ($k_{off}/k_{on}$). Specific binding commonly refers to the formation of a complex between a receptor molecule and its ligands. In the context of antibody-antigen binding, high affinity antibodies typically bind their target antigens at affinities of $10^{-9}$ M or less.

In one embodiment, the binding molecule of the present invention can induce TRAILR2 mediated apoptosis in one or more cancer cell types, such as the colorectal cancer cell line Colo205, with more than 50% inhibition of cell viability at a concentration of 1 nM or less, and even more preferably less than 0.01 nM.

In a further embodiment, the binding molecule of the present invention cannot induce TRAILR2 mediated apoptosis in CDH17 negative liver derived cells, such as the cell line HepG2, with less than 50% inhibition of cell viability at a concentration of up to 1 nM, or more preferably up to 10 nM, and even more preferably up to 100 nM.

In a further preferred embodiment the at least one antigen binding site that binds specifically to cadherin-17 (CDH17) is an immunoglobulin (Ig) molecule (having the conventional Y shaped structure of a full length antibody comprising two heavy and two light chains) and the at least one antigen binding site that binds specifically to TNF-related apoptosis-inducing ligand receptor 2 (TRAILR2) comprises one or more scFv, scFab, Fab or Fv binding elements. Preferably the antigen binding site that binds specifically to TNF-related apoptosis-inducing ligand receptor 2 (TRAILR2) comprises one or more scFv(s).

A "single chain Fv fragment" (scFv) is a polypeptide comprising an antibody heavy chain variable domain (VH), a linker, and an antibody light chain variable domain (VL), wherein said antibody domains and said linker have one of the following orders in N-terminal to C-terminal direction: a) VH-linker-VL, b) VL-linker-VH; and wherein said linker is a polypeptide of 15 to 25 amino acids, preferably 20 amino acids, in length.

In addition, these single chain Fv fragments might be further stabilized by incorporation of disulfide bonds between the VH and VL domains, within the VH domain, or within the VL domain, via incorporation of cysteine residues. The term N-terminus denotes the first amino acid of the polypeptide chain while the term C-terminus denotes the last amino acid of the C-terminus of the polypeptide chain. Hence an embodiment of the invention is wherein the one or more scFv(s) comprises additional cysteine residues to form disulfide bonds In an embodiment of the invention, stability of the scFv moiety can be increased by incorporation of two cysteine residues in close 3-dimensional proximity to form a disulfide bond within the scFv (referred to herein as scFvss). Where the scFv is derived from the V region sequences of TRv1 (as discussed below), example potential sites where such stabilizing disulfide bonds can be engineered include: (a) between position 99 of VL and position 45 of VH, (b) between position 102 of VL and position 44 of VH, (c) between positions 4 and 100 of VL, and (d) between positions 6 and 112 of VH. To effect stabilization through engineered disulfide bonds, residues at these positions are preferably substituted with cysteine residues.

As demonstrated in the accompanying examples, the inventors have shown that a TRAILR2 scFv having a VL-VH orientation from N- to C-terminus can function in the binding molecules of the invention to induce apoptosis in target cells. While a TRAILR2 scFv having a VH-VL orientation from N- to C-terminus can also function, the activity may be reduced in this orientation. Hence a preferred embodiment of the invention is where the order is VL-VH from N- to C-terminus.

A further preferred embodiment of the invention is wherein the one or more scFv(s) specifically binding to TRAILR2 is fused to the Ig molecule (e.g., human IgG1, IgG1(KO), IgG1FcRnmut, IgG4Pro) specifically binding to CDH17 by a peptide linker, preferably a peptide linker having a length of about 4 to 20 amino acids (e.g., anyone of 6, 9, 12, or 15). Preferably the scFv is fused to the C-terminus of the heavy chain of the Ig molecule. Preferably the Ig molecule is an IgG.

Methods of linking scFv molecules to the C-terminus of the heavy chain of the IgG molecule or linking the variable domains within scFv molecules are well known in the art. Typically a small linker sequence of glycine and serine (termed a GS mini-linker) amino acids is used. The number of amino acids in the linker can vary, from 4 (GGGS) (SEQ ID NO:144), 6 (GGSGGS) (SEQ ID NO:141), 10 (GGGGSGGGGS) (SEQ ID NO:142) or more. In practice, normally the linker is formed by combining the nucleic acid molecule encoding the IgG of interest (which in the present case would include the nucleic acid encoding the variable domain of the heavy chain for the CDH17 binding site and constant domains of the IgG type) with the nucleic acid encoding the desired scFv (which in the present case would include the nucleic acid encoding the variable domain of the heavy and light chain, either in VL-VH or VH-VL orientation for the TRAILR2 binding site) interspaced by the nucleic acid molecule encoding the linker sequence (e.g. a GS mini linker of any one of 5, 10, 15, or 20 amino acids, preferably a linker of SEQ ID NO:143). Then as further explained below this complete HC-scFv encoding nucleic acid molecule is placed within an expression vector and introduced to appropriate host cells such that the complete IgG heavy chain-scFv single polypeptide is formed.

Preferably the GS mini-linker between the scFV molecule and the C-terminus of the heavy chain of the IgG molecule is GGSGGS (SEQ ID NO:141).

In one embodiment, the present invention provides a binding molecule which is a multi-specific binding protein comprising (i) an Ig molecule specifically binding to CDH17 with two heavy and two light chains, and (ii) two scFv molecules (scFv(s)) each specifically binding to TRAILR2. Preferably, each heavy chain of the Ig molecule has one scFv fused to its C-terminus, thereby forming a bispecific tetravalent binding protein.

In one embodiment, the present invention provides a binding molecule (also referred to herein multi-specific binding protein or a modified Ig molecule) with:
(i) two heavy chains, each comprising from N to C terminus:
  a heavy chain variable domain specific for CDH17 (e.g., murine, humanized or human VH domain)
  constant domains of an IgG (e.g. human IgG1 or IgG4)
  a peptide linker (e.g. a GS mini linker) and
  an scFv specific for TRAILR2 (e.g. an scFv comprising from N to C terminus a VH domain (e.g. murine, humanized or human VH domain) a linker and a VL domain (e.g. murine, humanized or human VL domain), or vice versa a VL domain a linker and a VH domain); and
(ii) two light chains, each comprising from N to C-terminus:
  a light chain variable domain specific for CDH17 (e.g. murine, humanized or human VL domain),
  a light chain constant domain (e.g., a human kappa chain).

The antibody molecule or binding molecule described herein may be fused (as a fusion protein) or otherwise linked (by covalent or non-covalent bonds) to other molecular entities having a desired impact on the properties of the antibody molecule. For example, it may be desirable to improve pharmacokinetic properties of antibody or binding molecules described herein, stability e.g. in body fluids such as blood, in particular in the case of single chain antibodies or domain antibodies. A number of technologies have been developed in this regard, in particular to prolong the half-life of such antibody molecules in the circulation, such as pegylation (WO 98/25971; WO 98/48837; WO 2004081026), fusing or otherwise covalently attaching the antibody molecule to another antibody molecule having affinity to a serum protein like albumin (WO 2004041865; WO 2004003019), or expression of the antibody molecule as fusion protein with all or part of a serum protein like albumin or transferrin (WO 01/79258).

Since the Fc region of an antibody interacts with a number of Fc receptors, which results in a number of important functional capabilities (which are referred to as "effector functions"), the antibody is, in certain embodiments, a full length antibody or an antibody that contains a portion of the Fc region, the latter as long as the antibody exhibits specific binding both to the relevant portion of the antigen and to Fc receptors and complements. The choice of the type and length of the constant region depends on whether effector functions like complement fixation or antibody-dependent cell-mediated cytotoxicity are desirable features, and on the desired pharmacological properties of the antibody protein.

In an embodiment of the invention, binding to complement product C1q or Fc gamma receptor by the binding molecule in this invention is ablated by utilization of the IgG4 constant region or of the IgG1 constant region with directed L to A mutagenesis at positions 234 and 235.

In an embodiment of the invention, the binding molecule of the invention may have an Fc region, or the relevant section thereof, that has been engineered to avoid unintended cross-linking by soluble Fc gamma receptors or complement C1q. In one embodiment, such binding molecule or antibody variant has much lower affinities to Fcgamma receptors and complement C1q than the parent antibody. (In the following, if not otherwise stated, the term "parent" in the context of an antibody molecule, or in the context of IgG or the Fc region, refers to the non-engineered antibody molecule, Fc region or IgG, respectively, from which the mutated (engineered) molecule is derived.). Hence an embodiment of the invention is wherein the Ig molecule comprises a Fc variant having a reduced affinity to Fc gamma receptors or complement receptors or both compared to a wildtype Fc region. Such Ig molecule is referred to herein as IgG1(KO).

A further embodiment of the invention is wherein the binding molecule of the invention comprises an Fc region, or the relevant section thereof, that has been engineered to modify serum levels (half-life) by optimizing its interaction with the neonatal Fc receptor (FcRn), e.g. by a point mutation in the CH2 domain at position H310A). Such Ig molecule is referred to herein as IgG1FcRnmut.

A further embodiment of the invention is wherein the binding molecule comprises an Ig molecule which comprises a hinge region variant of IgG4 that ablates swapping of the heavy chains with other IgG4 molecules. Such Ig molecule is referred to herein as IgG4Pro.

The present invention provides a binding molecule having at least one antigen binding site that binds specifically to TNF-related apoptosis-inducing ligand receptor 2 (TRAILR2) and at least one antigen binding site that binds specifically to cadherin-17 (CDH17).

Methods of preparing binding sites that bind to specific target antigens are well known in the art. The skilled person can readily use these methods to devise an antigen binding site having the necessary specificity for the TRAILR2 or CDH17 target antigens.

Methods of generating antibodies and antibody fragments are well known in the art. For example, antibodies may be generated via any one of several methods which employ induction of in vivo production of antibody molecules, screening of immunoglobulin libraries (Orlandi et al, 1989. Proc. Natl. Acad. Sci. U.S.A. 86:3833-3837; Winter et al 1991, Nature 349:293-299) or generation of monoclonal antibody molecules by cell lines in culture. These include, but are not limited to, the hybridoma technique, the human B-cell hybridoma technique, and the Epstein-Barr virus (EBV)-hybridoma technique (Kohler et al 1975. Nature 256:4950497; Kozbor et al 1985. J. Immunol. Methods 81:31-42; Cote et al 1983. Proc. Natl. Acad. Sci. USA 80:2026-2030; Cole et al 1984. Mol. Cell. Biol. 62:109-120).

Using methods known in the art and described herein it would be routine for the person skilled in the art to prepare antibodies having a binding site with the necessary specificity for the TRAILR2 and/or CDH17 target antigens as well as binding molecules described herein. Isolation of the binding domains from such antibodies is a routine practice and indeed further information on methods that can be used to generate antibodies and binding molecules as described herein are provided in the accompanying examples.

The present inventors prepared specific TRAILR2/CDH17 binding molecules of the invention which are discussed in the accompanying examples.

The inventors prepared a number of antigen binding sites specific for TRAILR2, and termed these TR #1, TR #2, TR #3, TR #7, TR #8, TR #10, TR #12, TR2v1, TR2v2, TR2v3, TR2v4, TR2v5, TR2v6, and TR2v7. The inventors also prepared a number of antigen binding sites specific for CDH17, and termed these CDH17A6, CDH17E2, CDH17H2, CDH17E9 and CDH17v1. In any of the embodiments provided below, the binding molecule comprises at least one antigen binding site specifically binding to CDH17 (any one of CDH17A6, CDH17E2, CDH17H2, CDH17E9 and CDH17v1), and at least one antigen binding site specifically binding to TRAILR2 (any one of TR #1, TR #2, TR #3, TR #7, TR #8, TR #10, TR #12, TR2v1, TR2v2, TR2v3, TR2v4, TR2v5, TR2v6, and TR2v7). Preferably, the at least one antigen binding site specific for CDH17 is an Ig molecule (comprising two heavy and two light chains) and the at least one antigen binding site specifically binding to TRAILR2 comprises two scFv(s)), wherein one scFv is bound to the C-terminus of one of the heavy chains and one scFv is bound to the C-terminus of the other heavy chain of the Ig molecule forming a bispecific and tetravalent binding protein.

In some embodiments, the antigen binding site (any one of TR #1, TR #2, TR #3, TR #7, TR #8, TR #10, TR #12, TR2v1, TR2v2, TR2v3, TR2v4, TR2v5, TR2v6, TR2v7, CDH17A6, CDH17E2, CDH17H2, CDH17E9 and CDH17v1) is a "humanized" antigen binding site (e.g., comprising humanized VH/VL domain) comprising amino acid residues from non-human hypervariable regions (HVRs; e.g. complementary determining regions (CDRs)) and amino acid residues from human frame work sequences. In some embodiments, the antigen binding site (any one of TR #1, TR #2, TR #3, TR #7, TR #8, TR #10, TR #12, TR2v1, TR2v2, TR2v3, TR2v4, TR2v5, TR2v6, TR2v7, CDH17A6, CDH17E2, CDH17H2, CDH17E9 and CDH17v1) is a human antigen binding site (e.g. comprising human VH/VL domain) comprising CDR and FR sequences which are both derived from sequences of the human genome.

The amino acid sequences of the specific antigen binding sites are provided in the description (Table 3) and the sequence listing.

Provided below are details of preferred embodiments of the invention which comprise specific antigen binding sites for TRAILR2 and/or CDH17.

For the avoidance of doubt, each of the specific embodiments listed below for the first aspect of the invention can each also be considered to be independent aspects of the invention.

In a preferred embodiment of the binding molecule of the invention, the antigen binding site specific for TRAILR2 comprises heavy chain CDRs comprising the amino acid sequences of SEQ ID NO.:1 (CDR1), SEQ ID NO.:2 (CDR2) and SEQ ID NO.:3 (CDR3) and light chain CDRs comprising the amino acid sequences of SEQ ID NO.:4 (CDR1), SEQ ID NO.:5 (CDR2) and SEQ ID NO.:6 (CDR3). In this embodiment the antigen binding site specific for TRAILR2 is TR #1.

Preferably the antigen binding site specific for TRAILR2 comprises a heavy chain variable domain comprising the amino acid sequence of SEQ ID NO.:82 and a light chain variable domain comprising the amino acid sequence of SEQ ID NO.:83. In this embodiment the antigen binding site specific for TRAILR2 is TR #1. For example, the antigen binding site specific for TRAILR2 comprises an scFv molecule comprising the amino acid sequence of SEQ ID NO: 134 (orientation VL-VH).

In a preferred embodiment of the binding molecule of the invention, the antigen binding site specific for TRAILR2 comprises heavy chain CDRs comprising the amino acid sequences of SEQ ID NO.:7 (CDR1), SEQ ID NO.:8 (CDR2) and SEQ ID NO.:9 (CDR3) and light chain CDRs comprising the amino acid sequences of SEQ ID NO.:10 (CDR1), SEQ ID NO.11 (CDR2) and SEQ ID NO.:12 (CDR3). In this embodiment the antigen binding site specific for TRAILR2 is TR #2.

Preferably the antigen binding site specific for TRAILR2 comprises a heavy chain variable domain comprising the amino acid sequence of SEQ ID NO.:84 and a light chain variable domain comprising the amino acid sequence of SEQ ID NO.:85. In this embodiment the antigen binding site specific for TRAILR2 is TR #2. For example, the antigen binding site specific for TRAILR2 comprises an scFv molecule comprising the amino acid sequence of SEQ ID NO: 135 (orientation VL-VH).

In a preferred embodiment of the binding molecule of the invention, the antigen binding site specific for TRAILR2 comprises heavy chain CDRs comprising the amino acid sequences of SEQ ID NO.:13 (CDR1), SEQ ID NO.:14 (CDR2) and SEQ ID NO.:15 (CDR3) and light chain CDRs comprising the amino acid sequences of SEQ ID NO.:16 (CDR1), SEQ ID NO.17 (CDR2) and SEQ ID NO.:18 (CDR3). In this embodiment the antigen binding site specific for TRAILR2 is TR #3.

Preferably the antigen binding site specific for TRAILR2 comprises a heavy chain variable domain comprising the amino acid sequence of SEQ ID NO.:86 and a light chain variable domain comprising the amino acid sequence of SEQ ID NO.:87. In this embodiment the antigen binding site specific for TRAILR2 is TR #3. For example, the antigen binding site specific for TRAILR2 comprises an scFv molecule comprising the amino acid sequence of SEQ ID NO: 136 (orientation VL-VH).

In a preferred embodiment of the binding molecule of the invention, the antigen binding site specific for TRAILR2 comprises heavy chain CDRs comprising the amino acid sequences of SEQ ID NO.:19 (CDR1), SEQ ID NO.:20 (CDR2) and SEQ ID NO.:21 (CDR3) and light chain CDRs comprising the amino acid sequences of SEQ ID NO.:22 (CDR1), SEQ ID NO.23 (CDR2) and SEQ ID NO.:24 (CDR3). In this embodiment the antigen binding site specific for TRAILR2 is TR #7.

Preferably the antigen binding site specific for TRAILR2 comprises a heavy chain variable domain comprising the amino acid sequence of SEQ ID NO.:88 and a light chain variable domain comprising the amino acid sequence of SEQ ID NO.:89. In this embodiment the antigen binding site specific for TRAILR2 is TR #7. For example, the antigen binding site specific for TRAILR2 comprises an scFv molecule comprising the amino acid sequence of SEQ ID NO: 137 (orientation VL-VH).

In a preferred embodiment of the binding molecule of the invention, the antigen binding site specific for TRAILR2 comprises heavy chain CDRs comprising the amino acid sequences of SEQ ID NO.:25 (CDR1), SEQ ID NO.:26 (CDR2) and SEQ ID NO.:27 (CDR3) and light chain CDRs comprising the amino acid sequences of SEQ ID NO.:28 (CDR1), SEQ ID NO.29 (CDR2) and SEQ ID NO.:30 (CDR3). In this embodiment the antigen binding site specific for TRAILR2 is TR #8.

Preferably the antigen binding site specific for TRAILR2 comprises a heavy chain variable domain comprising the amino acid sequence of SEQ ID NO.:90 and a light chain variable domain comprising the amino acid sequence of SEQ ID NO.:91. In this embodiment the antigen binding site specific for TRAILR2 is TR #8. For example, the antigen binding site specific for TRAILR2 comprises an scFv molecule comprising the amino acid sequence of SEQ ID NO: 138 (orientation VL-VH).

In a preferred embodiment of the binding molecule of the invention, the antigen binding site specific for TRAILR2 comprises heavy chain CDRs comprising the amino acid sequences of SEQ ID NO.:31 (CDR1), SEQ ID NO.:32 (CDR2) and SEQ ID NO.:33 (CDR3) and light chain CDRs comprising the amino acid sequences of SEQ ID NO.:34 (CDR1), SEQ ID NO.35 (CDR2) and SEQ ID NO.:36 (CDR3). In this embodiment the antigen binding site specific for TRAILR2 is TR #10.

Preferably the antigen binding site specific for TRAILR2 comprises a variable heavy chain comprising the amino acid sequence of SEQ ID NO.:92 and a light chain variable domain comprising the amino acid sequence of SEQ ID NO.:93. In this embodiment the antigen binding site specific for TRAILR2 is TR #10. For example, the antigen binding site specific for TRAILR2 comprises an scFv molecule comprising the amino acid sequence of SEQ ID NO: 139 (orientation VL-VH).

In a preferred embodiment of the binding molecule of the invention, the antigen binding site specific for TRAILR2 comprises heavy chain CDRs comprising the amino acid sequences of SEQ ID NO.:37 (CDR1), SEQ ID NO.:38 (CDR2) and SEQ ID NO.:39 (CDR3) and light chain CDRs comprising the amino acid sequences of SEQ ID NO.:40 (CDR1), SEQ ID NO.41 (CDR2) and SEQ ID NO.:42 (CDR3). In this embodiment the antigen binding site specific for TRAILR2 is TR #12.

Preferably the antigen binding site specific for TRAILR2 comprises a heavy chain variable domain comprising the amino acid sequence of SEQ ID NO.:94 and a light chain variable domain comprising the amino acid sequence of SEQ ID NO.:95. In this embodiment the antigen binding site specific for TRAILR2 is TR #12. For example, the antigen binding site specific for TRAILR2 comprises an scFv molecule comprising the amino acid sequence of SEQ ID NO: 140 (orientation VL-VH).

In a preferred embodiment of the binding molecule of the invention, the antigen binding site specific for TRAILR2 comprises heavy chain CDRs comprising the amino acid sequences of SEQ ID NO.:43 (CDR1), SEQ ID NO.:44 (CDR2) and SEQ ID NO.:48 (CDR3) and light chain CDRs comprising the amino acid sequences of SEQ ID NO.:49 (CDR1), SEQ ID NO.50 (CDR2) and SEQ ID NO.:54 (CDR3). In this embodiment the antigen binding site specific for TRAILR2 is TR2v1 or TR2v2.

Preferably the antigen binding site specific for TRAILR2 comprises a heavy chain variable domain comprising the amino acid sequence of SEQ ID NO.:96 and a light chain variable domain comprising the amino acid sequence of SEQ ID NO.:97. In this embodiment the antigen binding site specific for TRAILR2 is TR2v1. For example, the antigen binding site specific for TRAILR2 comprises an scFv molecule comprising the amino acid sequence of SEQ ID NO: 124 (orientation VL-VH), SEQ ID NO: 131 (orientation VH-VL), SEQ ID NO: 132 (orientation VH-VL with disulfide bonds, scFvss) or SEQ ID NO: 133 (orientation VL-VH with dissulfide bonds, scFV).

Preferably the antigen binding site specific for TRAILR2 comprises a heavy chain variable domain comprising the amino acid sequence of SEQ ID NO.:98 and a light chain variable domain comprising the amino acid sequence of SEQ ID NO.:99. In this embodiment the antigen binding site specific for TRAILR2 is TR2v2. For example, the antigen binding site specific for TRAILR2 comprises an scFv molecule comprising the amino acid sequence of SEQ ID NO: 125 (orientation VL-VH).

In a preferred embodiment of the binding molecule of the invention, the antigen binding site specific for TRAILR2 comprises heavy chain CDRs comprising the amino acid sequences of SEQ ID NO.:43 (CDR1), SEQ ID NO.:45 (CDR2) and SEQ ID NO.:48 (CDR3) and light chain CDRs comprising the amino acid sequences of SEQ ID NO.:49 (CDR1), SEQ ID NO.51 (CDR2) and SEQ ID NO:55 (CDR3). In this embodiment the antigen binding site specific for TRAILR2 is TR2v3.

Preferably the antigen binding site specific for TRAILR2 comprises a heavy chain variable domain comprising the amino acid sequence of SEQ ID NO.:100 and a light chain variable domain comprising the amino acid sequence of SEQ ID NO.:101. In this embodiment the antigen binding site specific for TRAILR2 is TR2v3. For example, the antigen binding site specific for TRAILR2 comprises an scFv molecule comprising the amino acid sequence of SEQ ID NO: 126 (orientation VL-VH).

In a preferred embodiment of the binding molecule of the invention, the antigen binding site specific for TRAILR2 comprises heavy chain CDRs comprising the amino acid sequences of SEQ ID NO.:43 (CDR1), SEQ ID NO.:45 (CDR2) and SEQ ID NO.:48 (CDR3) and light chain CDRs comprising the amino acid sequences of SEQ ID NO.:49 (CDR1), SEQ ID NO.52 (CDR2) and SEQ ID NO.:56 (CDR3). In this embodiment the antigen binding site specific for TRAILR2 is TR2v4.

Preferably the antigen binding site specific for TRAILR2 comprises a heavy chain variable domain comprising the amino acid sequence of SEQ ID NO.:102 and a light chain variable domain comprising the amino acid sequence of SEQ ID NO.:103. In this embodiment the antigen binding site specific for TRAILR2 is TR2v4. For example, the antigen binding site specific for TRAILR2 comprises an scFv molecule comprising the amino acid sequence of SEQ ID NO: 127 (orientation VL-VH).

In a preferred embodiment of the binding molecule of the invention, the antigen binding site specific for TRAILR2 comprises heavy chain CDRs comprising the amino acid sequences of SEQ ID NO.:43 (CDR1), SEQ ID NO.:45 (CDR2) and SEQ ID NO.:48 (CDR3) and light chain CDRs comprising the amino acid sequences of SEQ ID NO.:49 (CDR1), SEQ ID NO.50 (CDR2) and SEQ ID NO.:56 (CDR3). In this embodiment the antigen binding site specific for TRAILR2 is TR2v5.

Preferably the antigen binding site specific for TRAILR2 comprises a heavy chain variable domain comprising the amino acid sequence of SEQ ID NO.:104 and a light chain variable domain comprising the amino acid sequence of SEQ ID NO.:105. In this embodiment the antigen binding site specific for TRAILR2 is TR2v5. For example, the antigen binding site specific for TRAILR2 comprises an scFv molecule comprising the amino acid sequence of SEQ ID NO: 128 (orientation VL-VH).

In a preferred embodiment of the binding molecule of the invention, the antigen binding site specific for TRAILR2 comprises heavy chain CDRs comprising the amino acid sequences of SEQ ID NO.:43 (CDR1), SEQ ID NO.:46 (CDR2) and SEQ ID NO.:48 (CDR3) and light chain CDRs comprising the amino acid sequences of SEQ ID NO.:49 (CDR1), SEQ ID NO.51 (CDR2) and SEQ ID NO.:57 (CDR3). In this embodiment the antigen binding site specific for TRAILR2 is TR2v6.

Preferably the antigen binding site specific for TRAILR2 comprises a heavy chain variable domain comprising the amino acid sequence of SEQ ID NO.:106 and a light chain variable domain comprising the amino acid sequence of SEQ ID NO.:107. In this embodiment the antigen binding site specific for TRAILR2 is TR2v6. For example, the antigen binding site specific for TRAILR2 comprises an scFv molecule comprising the amino acid sequence of SEQ ID NO: 129 (orientation VL-VH).

In a preferred embodiment of the binding molecule of the invention, the antigen binding site specific for TRAILR2 comprises heavy chain CDRs comprising the amino acid sequences of SEQ ID NO.:43 (CDR1), SEQ ID NO.:47 (CDR2) and SEQ ID NO.:48 (CDR3) and has light chain CDRs comprising the amino acid sequences of SEQ ID NO.:49 (CDR1), SEQ ID NO.53 (CDR2) and SEQ ID NO.:57 (CDR3). In this embodiment the antigen binding site specific for TRAILR2 is TR2v7.

Preferably the antigen binding site specific for TRAILR2 comprises a heavy chain variable domain comprising the amino acid sequence of SEQ ID NO.:108 and a light chain variable domain comprising the amino acid sequence of SEQ ID NO.:109. In this embodiment the antigen binding site specific for TRAILR2 is TR2v7. For example, the antigen binding site specific for TRAILR2 comprises an scFv molecule comprising the amino acid sequence of SEQ ID NO: 130 (orientation VL-VH).

In a preferred embodiment of the binding molecule of the invention, the antigen binding site specific for CDH17 comprises heavy chain CDRs comprising the amino acid sequences of SEQ ID NO.:58 (CDR1), SEQ ID NO.:59 (CDR2) and SEQ ID NO.:60 (CDR3) and has light chain CDRs comprising the amino acid sequences of SEQ ID NO.:61 (CDR1), SEQ ID NO.62 (CDR2) and SEQ ID NO.:63 (CDR3). In this embodiment the antigen binding site specific for CDH17 is CDH17E9.

Preferably the antigen binding site specific for CDH17 comprises a heavy chain variable domain comprising the amino acid sequence of SEQ ID NO.:110 and a light chain variable domain comprising the amino acid sequence of SEQ ID NO.:111. In this embodiment the antigen binding site specific for CDH17 is CDH17E9.

In a preferred embodiment of the binding molecule of the invention, the antigen binding site specific for CDH17 comprises heavy chain CDRs comprising the amino acid sequences of SEQ ID NO.:64 (CDR1), SEQ ID NO.:65 (CDR2) and SEQ ID NO.:66 (CDR3) and has light chain CDRs comprising the amino acid sequences of SEQ ID NO.:67 (CDR1), SEQ ID NO.68 (CDR2) and SEQ ID NO.:69 (CDR3). In this embodiment the antigen binding site specific for CDH17 is CDH17A6.

Preferably the antigen binding site specific for CDH17 comprises a heavy chain variable domain comprising the amino acid sequence of SEQ ID NO.:112 and a light chain variable domain comprising the amino acid sequence of SEQ ID NO.:113. In this embodiment the antigen binding site specific for CDH17 is CDH17A6.

In a preferred embodiment of the binding molecule of the invention, the antigen binding site specific for CDH17 comprises heavy chain CDRs comprising the amino acid sequences of SEQ ID NO.:70 (CDR1), SEQ ID NO.:71 (CDR2) and SEQ ID NO.:72 (CDR3) and has light chain CDRs comprising the amino acid sequences of SEQ ID NO.:73 (CDR1), SEQ ID NO.74 (CDR2) and SEQ ID NO.:75 (CDR3). In this embodiment the antigen binding site specific for CDH17 is CDH17E2 or CDH17H2.

Preferably the antigen binding site specific for CDH17 comprises a heavy chain variable domain comprising the amino acid sequence of SEQ ID NO.:114 and a light chain variable domain comprising the amino acid sequence of SEQ ID NO.:115. In this embodiment the antigen binding site specific for CDH17 is CDH17E2.

Preferably the antigen binding site specific for CDH17 comprises a heavy chain variable domain comprising the amino acid sequence of SEQ ID NO.:116 and a light chain variable domain comprising the amino acid sequence of SEQ ID NO.:117. In this embodiment the antigen binding site specific for CDH17 is CDH17H2.

In a preferred embodiment of the binding molecule of the invention, the antigen binding site specific for CDH17 comprises heavy chain CDRs comprising the amino acid sequences of SEQ ID NO.:76 (CDR1), SEQ ID NO.:77 (CDR2) and SEQ ID NO.:78 (CDR3) and has light chain CDRs comprising the amino acid sequences of SEQ ID NO.:79 (CDR1), SEQ ID NO.80 (CDR2) and SEQ ID NO.:81 (CDR3). In this embodiment the antigen binding site specific for CDH17 is CDH17v1.

Preferably the antigen binding site specific for CDH17 comprises a heavy chain variable domain comprising the amino acid sequence of SEQ ID NO.:118 and a light chain variable domain comprising the amino acid sequence of SEQ ID NO.:119. In this embodiment the antigen binding site specific for CDH17 is CDH17v1.

In a preferred embodiment of the binding molecule of the invention, the antigen binding site specific for TRAILR2 comprises heavy chain CDRs comprising the amino acid sequences of SEQ ID NO.:1 (CDR1), SEQ ID NO.:2 (CDR2) and SEQ ID NO.:3 (CDR3) and light chain CDRs comprising the amino acid sequences of SEQ ID NO.:4 (CDR1), SEQ ID NO.:5 (CDR2) and SEQ ID NO.:6 (CDR3) and the antigen binding site specific for CDH17 comprises heavy chain CDRs comprising the amino acid sequences of SEQ ID NO.:58 (CDR1), SEQ ID NO.:59 (CDR2) and SEQ ID NO.:60 (CDR3) and light chain CDRs comprising the amino acid sequences of SEQ ID NO.:61 (CDR1), SEQ ID NO.62 (CDR2) and SEQ ID NO.:63 (CDR3) In this embodiment the antigen binding site specific for TRAILR2 is TR #1 and the antigen binding site specific for CDH17 is CDH17E9.

Preferably the antigen binding site specific for TRAILR2 comprises a heavy chain variable domain comprising the amino acid sequence of SEQ ID NO.:82 and a light chain variable domain comprising the amino acid sequence of SEQ ID NO.:83 and the antigen binding site specific for CDH17 comprises a heavy chain variable domain comprising the amino acid sequence of SEQ ID NO.:110 and a light chain variable domain comprising the amino acid sequence of SEQ ID NO.:111. In this embodiment the antigen binding site specific for TRAILR2 is TR #1 (e.g., scFv of SEQ ID NO: 134) and the antigen binding site specific for CDH17 is CDH17E9.

In a preferred embodiment of the binding molecule of the invention, the antigen binding site specific for TRAILR2 comprises heavy chain CDRs comprising the amino acid sequences of SEQ ID NO.:1 (CDR1), SEQ ID NO.:2 (CDR2) and SEQ ID NO.:3 (CDR3) and light chain CDRs comprising the amino acid sequences of SEQ ID NO.:4 (CDR1), SEQ ID NO.:5 (CDR2) and SEQ ID NO.:6 (CDR3) and the antigen binding site specific for CDH17 comprises heavy chain CDRs comprising the amino acid sequences of SEQ ID NO.:64 (CDR1), SEQ ID NO.:65 (CDR2) and SEQ ID NO.:66 (CDR3) and light chain CDRs comprising the amino acid sequences of SEQ ID NO.:67 (CDR1), SEQ ID NO.68 (CDR2) and SEQ ID NO.:69 (CDR3). In this embodiment the antigen binding site specific for TRAILR2 is TR #1 and the antigen binding site specific for CDH17 is CDH17A6.

Preferably the antigen binding site specific for TRAILR2 comprises a heavy chain variable domain comprising the amino acid sequence of SEQ ID NO.:82 and a light chain variable domain comprising the amino acid sequence of SEQ ID NO.:83 and the antigen binding site specific for CDH17 comprises a heavy chain variable domain comprising the amino acid sequence of SEQ ID NO.:112 and a light chain variable domain comprising the amino acid sequence of SEQ ID NO.:113. In this embodiment the antigen binding site specific for TRAILR2 is TR #1 (e.g., scFv of SEQ ID NO: 134) and the antigen binding site specific for CDH17 is CDH17A6.

In a preferred embodiment of the binding molecule of the invention, the antigen binding site specific for TRAILR2 comprises heavy chain CDRs comprising the amino acid sequences of SEQ ID NO.:1 (CDR1), SEQ ID NO.:2 (CDR2) and SEQ ID NO.:3 (CDR3) and light chain CDRs comprising the amino acid sequences of SEQ ID NO.:4 (CDR1), SEQ ID NO.:5 (CDR2) and SEQ ID NO.:6 (CDR3) and the antigen binding site specific for CDH17 comprises heavy chain CDRs comprising the amino acid sequences of SEQ ID NO.:70 (CDR1), SEQ ID NO.:71 (CDR2) and SEQ ID NO.:72 (CDR3) and light chain CDRs comprising the amino acid sequences of SEQ ID NO.:73 (CDR1), SEQ ID NO.74 (CDR2) and SEQ ID NO.:75 (CDR3). In this embodiment the antigen binding site specific for TRAILR2 is TR #1 and the antigen binding site specific for CDH17 is CDH17E2 or CDH17H2.

Preferably the antigen binding site specific for TRAILR2 comprises a heavy chain variable domain comprising the amino acid sequence of SEQ ID NO.:82 and a light chain variable domain comprising the amino acid sequence of SEQ ID NO.:83 and the antigen binding site specific for CDH17 comprises a heavy chain variable domain comprising the amino acid sequence of SEQ ID NO.:114 and a light chain variable domain comprising the amino acid sequence of SEQ ID NO.:115. In this embodiment the antigen binding site specific for TRAILR2 is TR #1 (e.g., scFv of SEQ ID NO: 134) and the antigen binding site specific for CDH17 is CDH17E2.

Preferably the antigen binding site specific for TRAILR2 comprises a heavy chain variable domain comprising the amino acid sequence of SEQ ID NO.:82 and a light chain variable domain comprising the amino acid sequence of SEQ ID NO.:83 and the antigen binding site specific for CDH17 comprises a heavy chain variable domain comprising the amino acid sequence of SEQ ID NO.:116 and a light chain variable domain comprising the amino acid sequence of SEQ ID NO.:117. In this embodiment the antigen binding site specific for TRAILR2 is TR #1 (e.g., scFv of SEQ ID NO: 134) and the antigen binding site specific for CDH17 is CDH17H2.

In a preferred embodiment of the binding molecule of the invention, the antigen binding site specific for TRAILR2 comprises heavy chain CDRs comprising the amino acid sequences of SEQ ID NO.:1 (CDR1), SEQ ID NO.:2 (CDR2) and SEQ ID NO.:3 (CDR3) and light chain CDRs comprising the amino acid sequences of SEQ ID NO.:4 (CDR1), SEQ ID NO.:5 (CDR2) and SEQ ID NO.:6 (CDR3) and the antigen binding site specific for CDH17 comprises heavy chain CDRs comprising the amino acid sequences of SEQ ID NO.:76 (CDR1), SEQ ID NO.:77 (CDR2) and SEQ ID NO.:78 (CDR3) and light chain CDRs comprising the amino acid sequences of SEQ ID NO.:79 (CDR1), SEQ ID NO.80 (CDR2) and SEQ ID NO.:81 (CDR3). In this embodiment the antigen binding site specific for TRAILR2 is TR #1 and the antigen binding site specific for CDH17 is CDH17v1.

Preferably the antigen binding site specific for TRAILR2 comprises a heavy chain variable domain comprising the amino acid sequence of SEQ ID NO.:82 and a light chain variable domain comprising the amino acid sequence of SEQ ID NO.:83 and the antigen binding site specific for CDH17 comprises a heavy chain variable domain comprising the amino acid sequence of SEQ ID NO.:118 and a light chain variable domain comprising the amino acid sequence of SEQ ID NO.:119. In this embodiment the antigen binding site specific for TRAILR2 is TR #1 (e.g., scFv of SEQ ID NO: 134) and the antigen binding site specific for CDH17 is CDH17v1.

In a preferred embodiment of the binding molecule of the invention, the antigen binding site specific for TRAILR2 comprises heavy chain CDRs comprising the amino acid sequences of SEQ ID NO.:7 (CDR1), SEQ ID NO.:8 (CDR2) and SEQ ID NO.:9 (CDR3) and light chain CDRs comprising the amino acid sequences of SEQ ID NO.:10 (CDR1), SEQ ID NO.11 (CDR2) and SEQ ID NO.:12 (CDR3 and the antigen binding site specific for CDH17 comprises heavy chain CDRs comprising the amino acid sequences of SEQ ID NO.:58 (CDR1), SEQ ID NO.:59 (CDR2) and SEQ ID NO.:60 (CDR3) and has light chain CDRs comprising the amino acid sequences of SEQ ID NO.:61 (CDR1), SEQ ID NO.62 (CDR2) and SEQ ID NO.:63 (CDR3) In this embodiment the antigen binding site specific for TRAILR2 is TR #2 and the antigen binding site specific for CDH17 is CDH17E9.

Preferably the antigen binding site specific for TRAILR2 comprises a heavy chain variable domain comprising the amino acid sequence of SEQ ID NO.:84 and a light chain variable domain comprising the amino acid sequence of SEQ ID NO.:85 and the antigen binding site specific for CDH17 comprises a heavy chain variable domain comprising the amino acid sequence of SEQ ID NO.:110 and a light chain variable domain comprising the amino acid sequence of SEQ ID NO.:111. In this embodiment the antigen binding site specific for TRAILR2 is TR #2 (e.g., scFv of SEQ ID NO: 135) and the antigen binding site specific for CDH17 is CDH17E9.

In a preferred embodiment of the binding molecule of the invention, the antigen binding site specific for TRAILR2 comprises heavy chain CDRs comprising the amino acid sequences of SEQ ID NO.:7 (CDR1), SEQ ID NO.:8 (CDR2) and SEQ ID NO.:9 (CDR3) and light chain CDRs comprising the amino acid sequences of SEQ ID NO.:10 (CDR1), SEQ ID NO.11 (CDR2) and SEQ ID NO.:12 (CDR3 and the antigen binding site specific for CDH17 comprises heavy chain CDRs comprising the amino acid sequences of SEQ ID NO.:64 (CDR1), SEQ ID NO.:65 (CDR2) and SEQ ID NO.:66 (CDR3) and light chain CDRs comprising the amino acid sequences of SEQ ID NO.:67 (CDR1), SEQ ID NO.68 (CDR2) and SEQ ID NO.:69 (CDR3). In this embodiment the antigen binding site specific for TRAILR2 is TR #2 and the antigen binding site specific for CDH17 is CDH17A6.

Preferably the antigen binding site specific for TRAILR2 comprises a heavy chain variable domain comprising the amino acid sequence of SEQ ID NO.:84 and a light chain variable domain comprising the amino acid sequence of SEQ ID NO.:85 and the antigen binding site specific for CDH17 comprises a heavy chain variable domain comprising the amino acid sequence of SEQ ID NO.:112 and a light chain variable domain comprising the amino acid sequence of SEQ ID NO.:113. In this embodiment the antigen binding site specific for TRAILR2 is TR #2 (e.g., scFv of SEQ ID NO: 135) and the antigen binding site specific for CDH17 is CDH17A6.

In a preferred embodiment of the binding molecule of the invention, the antigen binding site specific for TRAILR2 comprises heavy chain CDRs comprising the amino acid sequences of SEQ ID NO.:7 (CDR1), SEQ ID NO.:8 (CDR2) and SEQ ID NO.:9 (CDR3) and light chain CDRs comprising the amino acid sequences of SEQ ID NO.:10 (CDR1), SEQ ID NO.11 (CDR2) and SEQ ID NO.:12 (CDR3 and the antigen binding site specific for CDH17 comprises heavy chain CDRs comprising the amino acid sequences of SEQ ID NO.:70 (CDR1), SEQ ID NO.:71 (CDR2) and SEQ ID NO.:72 (CDR3) and light chain CDRs comprising the amino acid sequences of SEQ ID NO.:73 (CDR1), SEQ ID NO.74 (CDR2) and SEQ ID NO.:75 (CDR3). In this embodiment the antigen binding site specific for TRAILR2 is TR #2 and the antigen binding site specific for CDH17 is CDH17E2 or CDH17H2.

Preferably the antigen binding site specific for TRAILR2 comprises a heavy chain variable domain comprising the amino acid sequence of SEQ ID NO.:84 and a light chain variable domain comprising the amino acid sequence of SEQ ID NO.:85 and the antigen binding site specific for CDH17 comprises a heavy chain variable domain comprising the amino acid sequence of SEQ ID NO.:114 and a light chain variable domain comprising the amino acid sequence of SEQ ID NO.:115. In this embodiment the antigen binding site specific for TRAILR2 is TR #2 (e.g., scFv of SEQ ID NO: 135) and the antigen binding site specific for CDH17 is CDH17E2.

Preferably the antigen binding site specific for TRAILR2 comprises a heavy chain variable domain comprising the amino acid sequence of SEQ ID NO.:84 and a light chain variable domain comprising the amino acid sequence of SEQ ID NO.:85 and the antigen binding site specific for CDH17 comprises a heavy chain variable domain comprising the amino acid sequence of SEQ ID NO.:116 and a light chain variable domain comprising the amino acid sequence of SEQ ID NO.:117. In this embodiment the antigen binding site specific for TRAILR2 is TR #2 (e.g., scFv of SEQ ID NO: 135) and the antigen binding site specific for CDH17 is CDH17H2.

In a preferred embodiment of the binding molecule of the invention, the antigen binding site specific for TRAILR2 comprises heavy chain CDRs comprising the amino acid sequences of SEQ ID NO.:7 (CDR1), SEQ ID NO.:8 (CDR2) and SEQ ID NO.:9 (CDR3) and light chain CDRs comprising the amino acid sequences of SEQ ID NO.:10 (CDR1), SEQ ID NO.11 (CDR2) and SEQ ID NO.:12 (CDR3 and the antigen binding site specific for CDH17 comprises heavy chain CDRs comprising the amino acid sequences of SEQ ID NO.:76 (CDR1), SEQ ID NO.:77 (CDR2) and SEQ ID NO.:78 (CDR3) and light chain CDRs comprising the amino acid sequences of SEQ ID NO.:79 (CDR1), SEQ ID NO.80 (CDR2) and SEQ ID NO.:81 (CDR3). In this embodiment the antigen binding site specific for TRAILR2 is TR #2 and the antigen binding site specific for CDH17 is CDH17v1.

Preferably the antigen binding site specific for TRAILR2 comprises a heavy chain variable domain comprising the amino acid sequence of SEQ ID NO.:84 and a light chain variable domain comprising the amino acid sequence of SEQ ID NO.:85 and the antigen binding site specific for CDH17 comprises a heavy chain variable domain comprising the amino acid sequence of SEQ ID NO.:118 and a light chain variable domain comprising the amino acid sequence of SEQ ID NO.:119. In this embodiment the antigen binding site specific for TRAILR2 is TR #2 (e.g., scFv of SEQ ID NO: 135) and the antigen binding site specific for CDH17 is CDH17v1.

In a preferred embodiment of the binding molecule of the invention, the antigen binding site specific for TRAILR2 comprises heavy chain CDRs comprising the amino acid sequences of SEQ ID NO.:13 (CDR1), SEQ ID NO.:14 (CDR2) and SEQ ID NO.:15 (CDR3) and light chain CDRs comprising the amino acid sequences of SEQ ID NO.:16 (CDR1), SEQ ID NO.17 (CDR2) and SEQ ID NO.:18 (CDR3) and the antigen binding site specific for CDH17 comprises heavy chain CDRs comprising the amino acid sequences of SEQ ID NO.:58 (CDR1), SEQ ID NO.:59 (CDR2) and SEQ ID NO.:60 (CDR3) and light chain CDRs comprising the amino acid sequences of SEQ ID NO.:61 (CDR1), SEQ ID NO.62 (CDR2) and SEQ ID NO.:63 (CDR3). In this embodiment the antigen binding site specific for TRAILR2 is TR #3 and the antigen binding site specific for CDH17 is CDH17E9.

Preferably the antigen binding site specific for TRAILR2 comprises a heavy chain variable domain comprising the amino acid sequence of SEQ ID NO.:86 and a light chain variable domain comprising the amino acid sequence of SEQ ID NO.:87. and the antigen binding site specific for CDH17 comprises a heavy chain variable domain comprising the amino acid sequence of SEQ ID NO.:110 and a light chain variable domain comprising the amino acid sequence of SEQ ID NO.:111. In this embodiment the antigen binding site specific for TRAILR2 is TR #3 (e.g., scFv of SEQ ID NO: 136) and the antigen binding site specific for CDH17 is CDH17E9.

In a preferred embodiment of the binding molecule of the invention, the antigen binding site specific for TRAILR2 comprises heavy chain CDRs comprising the amino acid sequences of SEQ ID NO.:13 (CDR1), SEQ ID NO.:14 (CDR2) and SEQ ID NO.:15 (CDR3) and light chain CDRs comprising the amino acid sequences of SEQ ID NO.:16 (CDR1), SEQ ID NO.17 (CDR2) and SEQ ID NO.:18 (CDR3) and the antigen binding site specific for CDH17 comprises heavy chain CDRs comprising the amino acid sequences of SEQ ID NO.:64 (CDR1), SEQ ID NO.:65 (CDR2) and SEQ ID NO.:66 (CDR3) and light chain CDRs comprising the amino acid sequences of SEQ ID NO.:67 (CDR1), SEQ ID NO.68 (CDR2) and SEQ ID NO.:69 (CDR3). In this embodiment the antigen binding site specific for TRAILR2 is TR #3 and the antigen binding site specific for CDH17 is CDH17A6.

Preferably the antigen binding site specific for TRAILR2 comprises a heavy chain variable domain comprising the amino acid sequence of SEQ ID NO.:86 and a light chain variable domain comprising the amino acid sequence of SEQ ID NO.:87 and the antigen binding site specific for CDH17 comprises a heavy chain variable domain comprising the amino acid sequence of SEQ ID NO.:112 and a light chain variable domain comprising the amino acid sequence of SEQ ID NO.:113. In this embodiment the antigen binding site specific for TRAILR2 is TR #3 (e.g., scFv of SEQ ID NO: 136) and the antigen binding site specific for CDH17 is CDH17A6.

In a preferred embodiment of the binding molecule of the invention, the antigen binding site specific for TRAILR2 comprises heavy chain CDRs comprising the amino acid sequences of SEQ ID NO.:13 (CDR1), SEQ ID NO.:14 (CDR2) and SEQ ID NO.:15 (CDR3) and light chain CDRs comprising the amino acid sequences of SEQ ID NO.:16 (CDR1), SEQ ID NO.17 (CDR2) and SEQ ID NO.:18 (CDR3) and the antigen binding site specific for CDH17 comprises heavy chain CDRs comprising the amino acid sequences of SEQ ID NO.:70 (CDR1), SEQ ID NO.:71 (CDR2) and SEQ ID NO.:72 (CDR3) and light chain CDRs comprising the amino acid sequences of SEQ ID NO.:73 (CDR1), SEQ ID NO.74 (CDR2) and SEQ ID NO.:75 (CDR3). In this embodiment the antigen binding site specific for TRAILR2 is TR #3 and the antigen binding site specific for CDH17 is CDH17E2 or CDH17H2.

Preferably the antigen binding site specific for TRAILR2 comprises a heavy chain variable domain comprising the amino acid sequence of SEQ ID NO.:86 and a light chain variable domain comprising the amino acid sequence of SEQ ID NO.:87 and the antigen binding site specific for CDH17 comprises a heavy chain variable domain comprising the amino acid sequence of SEQ ID NO.:114 and a light chain variable domain comprising the amino acid sequence of SEQ ID NO.:115. In this embodiment the antigen binding site specific for TRAILR2 is TR #3 (e.g., scFv of SEQ ID NO: 136) and the antigen binding site specific for CDH17 is CDH17E2.

Preferably the antigen binding site specific for TRAILR2 comprises a heavy chain variable domain comprising the amino acid sequence of SEQ ID NO.:86 and a light chain variable domain comprising the amino acid sequence of SEQ ID NO.:87 and the antigen binding site specific for CDH17 comprises a heavy chain variable domain comprising the amino acid sequence of SEQ ID NO.:116 and a light chain variable domain comprising the amino acid sequence of SEQ ID NO.:117. In this embodiment the antigen binding site specific for TRAILR2 is TR #3 (e.g., scFv of SEQ ID NO: 136) and the antigen binding site specific for CDH17 is CDH17H2.

In a preferred embodiment of the binding molecule of the invention, the antigen binding site specific for TRAILR2 comprises heavy chain CDRs comprising the amino acid sequences of SEQ ID NO.:13 (CDR1), SEQ ID NO.:14 (CDR2) and SEQ ID NO.:15 (CDR3) and light chain CDRs comprising the amino acid sequences of SEQ ID NO.:16 (CDR1), SEQ ID NO.17 (CDR2) and SEQ ID NO.:18 (CDR3) and the antigen binding site specific for CDH17 comprises heavy chain CDRs comprising the amino acid sequences of SEQ ID NO.:76 (CDR1), SEQ ID NO.:77 (CDR2) and SEQ ID NO.:78 (CDR3) and light chain CDRs comprising the amino acid sequences of SEQ ID NO.:79 (CDR1), SEQ ID NO.80 (CDR2) and SEQ ID NO.:81 (CDR3). In this embodiment the antigen binding site specific for TRAILR2 is TR #3 and the antigen binding site specific for CDH17 is CDH17v1.

Preferably the antigen binding site specific for TRAILR2 comprises a heavy chain variable domain comprising the amino acid sequence of SEQ ID NO.:86 and a light chain variable domain comprising the amino acid sequence of SEQ ID NO.:87 and the antigen binding site specific for CDH17 comprises a heavy chain variable domain comprising the amino acid sequence of SEQ ID NO.:118 and a light chain variable domain comprising the amino acid sequence of SEQ ID NO.:119. In this embodiment the antigen binding site specific for TRAILR2 is TR #3 (e.g., scFv of SEQ ID NO: 136) and the antigen binding site specific for CDH17 is CDH17v1.

In a preferred embodiment of the binding molecule of the invention, the antigen binding site specific for TRAILR2 comprises heavy chain CDRs comprising the amino acid sequences of SEQ ID NO.:19 (CDR1), SEQ ID NO.:20 (CDR2) and SEQ ID NO.:21 (CDR3) and light chain CDRs comprising the amino acid sequences of SEQ ID NO.:22 (CDR1), SEQ ID NO.23 (CDR2) and SEQ ID NO.:24 (CDR3) and the antigen binding site specific for CDH17 comprises heavy chain CDRs comprising the amino acid sequences of SEQ ID NO.:58 (CDR1), SEQ ID NO.:59 (CDR2) and SEQ ID NO.:60 (CDR3) and light chain CDRs comprising the amino acid sequences of SEQ ID NO.:61 (CDR1), SEQ ID NO.62 (CDR2) and SEQ ID NO.:63 (CDR3). In this embodiment the antigen binding site specific for TRAILR2 is TR #7 and the antigen binding site specific for CDH17 is CDH17E9.

Preferably the antigen binding site specific for TRAILR2 comprises a heavy chain variable domain comprising the amino acid sequence of SEQ ID NO.:88 and a light chain variable domain comprising the amino acid sequence of SEQ ID NO.:89 and the antigen binding site specific for CDH17 comprises a heavy chain variable domain comprising the amino acid sequence of SEQ ID NO.:110 and a light chain variable domain comprising the amino acid sequence of SEQ ID NO.:111. In this embodiment the antigen binding site specific for TRAILR2 is TR #7 (e.g., scFv of SEQ ID NO: 137) and the antigen binding site specific for CDH17 is CDH17E9.

In a preferred embodiment of the binding molecule of the invention, the antigen binding site specific for TRAILR2 comprises heavy chain CDRs comprising the amino acid sequences of SEQ ID NO.:19 (CDR1), SEQ ID NO.:20 (CDR2) and SEQ ID NO.:21 (CDR3) and light chain CDRs comprising the amino acid sequences of SEQ ID NO.:22 (CDR1), SEQ ID NO.23 (CDR2) and SEQ ID NO.:24 (CDR3) and the antigen binding site specific for CDH17 comprises heavy chain CDRs comprising the amino acid sequences of SEQ ID NO.:64 (CDR1), SEQ ID NO.:65 (CDR2) and SEQ ID NO.:66 (CDR3) and light chain CDRs comprising the amino acid sequences of SEQ ID NO.:67 (CDR1), SEQ ID NO.68 (CDR2) and SEQ ID NO.:69 (CDR3). In this embodiment the antigen binding site specific for TRAILR2 is TR #7 and the antigen binding site specific for CDH17 is CDH17A6.

Preferably the antigen binding site specific for TRAILR2 comprises a heavy chain variable domain comprising the amino acid sequence of SEQ ID NO.:88 and a light chain variable domain comprising the amino acid sequence of SEQ ID NO.:89 and the antigen binding site specific for CDH17 comprises a heavy chain variable domain comprising the amino acid sequence of SEQ ID NO.:112 and a light chain variable domain comprising the amino acid sequence of SEQ ID NO.:113. In this embodiment the antigen binding site specific for TRAILR2 is TR #7 (e.g., scFv of SEQ ID NO: 137) and the antigen binding site specific for CDH17 is CDH17A6.

In a preferred embodiment of the binding molecule of the invention, the antigen binding site specific for TRAILR2 comprises heavy chain CDRs comprising the amino acid sequences of SEQ ID NO.:19 (CDR1), SEQ ID NO.:20 (CDR2) and SEQ ID NO.:21 (CDR3) and light chain CDRs comprising the amino acid sequences of SEQ ID NO.:22 (CDR1), SEQ ID NO.23 (CDR2) and SEQ ID NO.:24 (CDR3) and the antigen binding site specific for CDH17 comprises heavy chain CDRs comprising the amino acid sequences of SEQ ID NO.:70 (CDR1), SEQ ID NO.:71 (CDR2) and SEQ ID NO.:72 (CDR3) and light chain CDRs comprising the amino acid sequences of SEQ ID NO.:73 (CDR1), SEQ ID NO.74 (CDR2) and SEQ ID NO.:75 (CDR3). In this embodiment the antigen binding site specific for TRAILR2 is TR #7 and the antigen binding site specific for CDH17 is CDH17E2 or CDH17H2.

Preferably the antigen binding site specific for TRAILR2 comprises a heavy chain variable domain comprising the amino acid sequence of SEQ ID NO.:88 and a light chain variable domain comprising the amino acid sequence of SEQ ID NO.:89 and the antigen binding site specific for CDH17 comprises a heavy chain variable domain comprising the amino acid sequence of SEQ ID NO.:114 and a light chain variable domain comprising the amino acid sequence of SEQ ID NO.:115. In this embodiment the antigen binding site specific for TRAILR2 is TR #7 (e.g., scFv of SEQ ID NO: 137) and the antigen binding site specific for CDH17 is CDH17E2.

Preferably the antigen binding site specific for TRAILR2 comprises a heavy chain variable domain comprising the amino acid sequence of SEQ ID NO.:88 and a light chain variable domain comprising the amino acid sequence of SEQ ID NO.:89 and the antigen binding site specific for CDH17 comprises a heavy chain variable domain comprising the amino acid sequence of SEQ ID NO.:116 and a light chain variable domain comprising the amino acid sequence of SEQ ID NO.:117. In this embodiment the antigen binding site specific for TRAILR2 is TR #7 (e.g., scFv of SEQ ID NO: 137) and the antigen binding site specific for CDH17 is CDH17H2.

In a preferred embodiment of the binding molecule of the invention, the antigen binding site specific for TRAILR2 comprises heavy chain CDRs comprising the amino acid sequences of SEQ ID NO.:19 (CDR1), SEQ ID NO.:20 (CDR2) and SEQ ID NO.:21 (CDR3) and light chain CDRs comprising the amino acid sequences of SEQ ID NO.:22 (CDR1), SEQ ID NO.23 (CDR2) and SEQ ID NO.:24 (CDR3) and the antigen binding site specific for CDH17 comprises heavy chain CDRs comprising the amino acid sequences of SEQ ID NO.:76 (CDR1), SEQ ID NO.:77 (CDR2) and SEQ ID NO.:78 (CDR3) and light chain CDRs comprising the amino acid sequences of SEQ ID NO.:79 (CDR1), SEQ ID NO.80 (CDR2) and SEQ ID NO.:81 (CDR3). In this embodiment the antigen binding site specific for TRAILR2 is TR #7 and the antigen binding site specific for CDH17 is CDH17v1.

Preferably the antigen binding site specific for TRAILR2 comprises a heavy chain variable domain comprising the amino acid sequence of SEQ ID NO.:88 and a light chain variable domain comprising the amino acid sequence of SEQ ID NO.:89 and the antigen binding site specific for CDH17 comprises a heavy chain variable domain comprising the amino acid sequence of SEQ ID NO.:118 and a light chain variable domain comprising the amino acid sequence of SEQ ID NO.:119. In this embodiment the antigen binding site specific for TRAILR2 is TR #7 (e.g., scFv of SEQ ID NO: 137) and the antigen binding site specific for CDH17 is CDH17v1.

In a preferred embodiment of the binding molecule of the invention, the antigen binding site specific for TRAILR2 comprises heavy chain CDRs comprising the amino acid sequences of SEQ ID NO.:25 (CDR1), SEQ ID NO.:26 (CDR2) and SEQ ID NO.:27 (CDR3) and light chain CDRs comprising the amino acid sequences of SEQ ID NO.:28 (CDR1), SEQ ID NO.29 (CDR2) and SEQ ID NO.:30 (CDR3) and the antigen binding site specific for CDH17 comprises heavy chain CDRs comprising the amino acid sequences of SEQ ID NO.:58 (CDR1), SEQ ID NO.:59 (CDR2) and SEQ ID NO.:60 (CDR3) and light chain CDRs comprising the amino acid sequences of SEQ ID NO.:61 (CDR1), SEQ ID NO.62 (CDR2) and SEQ ID NO.:63 (CDR3). In this embodiment the antigen binding site specific for TRAILR2 is TR #8 and the antigen binding site specific for CDH17 is CDH17E9.

Preferably the antigen binding site specific for TRAILR2 comprises a heavy chain variable domain comprising the amino acid sequence of SEQ ID NO.:90 and a light chain variable domain comprising the amino acid sequence of SEQ ID NO.:91 and the antigen binding site specific for CDH17 comprises a heavy chain variable domain comprising the amino acid sequence of SEQ ID NO.:110 and a light chain variable domain comprising the amino acid sequence of SEQ ID NO.:111. In this embodiment the antigen binding site specific for TRAILR2 is TR #8 (e.g., scFv of SEQ ID NO: 138) and the antigen binding site specific for CDH17 is CDH17E9.

In a preferred embodiment of the binding molecule of the invention, the antigen binding site specific for TRAILR2 comprises heavy chain CDRs comprising the amino acid sequences of SEQ ID NO.:25 (CDR1), SEQ ID NO.:26 (CDR2) and SEQ ID NO.:27 (CDR3) and light chain CDRs comprising the amino acid sequences of SEQ ID NO.:28 (CDR1), SEQ ID NO.29 (CDR2) and SEQ ID NO.:30 (CDR3) and the antigen binding site specific for CDH17 comprises heavy chain CDRs comprising the amino acid sequences of SEQ ID NO.:64 (CDR1), SEQ ID NO.:65 (CDR2) and SEQ ID NO.:66 (CDR3) and light chain CDRs comprising the amino acid sequences of SEQ ID NO.:67 (CDR1), SEQ ID NO.68 (CDR2) and SEQ ID NO.:69 (CDR3). In this embodiment the antigen binding site specific for TRAILR2 is TR #8 and the antigen binding site specific for CDH17 is CDH17A6.

Preferably the antigen binding site specific for TRAILR2 comprises a heavy chain variable domain comprising the amino acid sequence of SEQ ID NO.:90 and a light chain variable domain comprising the amino acid sequence of SEQ ID NO.:91 and the antigen binding site specific for CDH17 comprises a heavy chain variable domain comprising the amino acid sequence of SEQ ID NO.:112 and a light chain variable domain comprising the amino acid sequence of SEQ ID NO.:113. In this embodiment the antigen binding site specific for TRAILR2 is TR #8 (e.g., scFv of SEQ ID NO: 138) and the antigen binding site specific for CDH17 is CDH17A6.

In a preferred embodiment of the binding molecule of the invention, the antigen binding site specific for TRAILR2 comprises heavy chain CDRs comprising the amino acid sequences of SEQ ID NO.:25 (CDR1), SEQ ID NO.:26 (CDR2) and SEQ ID NO.:27 (CDR3) and light chain CDRs comprising the amino acid sequences of SEQ ID NO.:28 (CDR1), SEQ ID NO.29 (CDR2) and SEQ ID NO.:30 (CDR3) and the antigen binding site specific for CDH17 comprises heavy chain CDRs comprising the amino acid sequences of SEQ ID NO.:70 (CDR1), SEQ ID NO.:71 (CDR2) and SEQ ID NO.:72 (CDR3) and light chain CDRs comprising the amino acid sequences of SEQ ID NO.:73 (CDR1), SEQ ID NO.74 (CDR2) and SEQ ID NO.:75 (CDR3). In this embodiment the antigen binding site specific for TRAILR2 is TR #8 and the antigen binding site specific for CDH17 is CDH17E2 or CDH17H2.

Preferably the antigen binding site specific for TRAILR2 comprises a heavy chain variable domain comprising the amino acid sequence of SEQ ID NO.:90 and a light chain variable domain comprising the amino acid sequence of SEQ ID NO.:91 and the antigen binding site specific for CDH17 comprises a heavy chain variable domain comprising the amino acid sequence of SEQ ID NO.:114 and a light chain variable domain comprising the amino acid sequence of SEQ ID NO.:115. In this embodiment the antigen binding site specific for TRAILR2 is TR #8 (e.g., scFv of SEQ ID NO: 138) and the antigen binding site specific for CDH17 is CDH17E2.

Preferably the antigen binding site specific for TRAILR2 comprises a heavy chain variable domain comprising the amino acid sequence of SEQ ID NO.:90 and a light chain variable domain comprising the amino acid sequence of SEQ ID NO.:91 and the antigen binding site specific for CDH17 comprises a heavy chain variable domain comprising the amino acid sequence of SEQ ID NO.:116 and a light chain variable domain comprising the amino acid sequence of SEQ ID NO.:117. In this embodiment the antigen binding site specific for TRAILR2 is TR #8 (e.g., scFv of SEQ ID NO: 138) and the antigen binding site specific for CDH17 is CDH17H2.

In a preferred embodiment of the binding molecule of the invention, the antigen binding site specific for TRAILR2 comprises heavy chain CDRs comprising the amino acid sequences of SEQ ID NO.:25 (CDR1), SEQ ID NO.:26 (CDR2) and SEQ ID NO.:27 (CDR3) and light chain CDRs comprising the amino acid sequences of SEQ ID NO.:28 (CDR1), SEQ ID NO.29 (CDR2) and SEQ ID NO.:30 (CDR3) and the antigen binding site specific for CDH17 comprises heavy chain CDRs comprising the amino acid sequences of SEQ ID NO.:76 (CDR1), SEQ ID NO.:77 (CDR2) and SEQ ID NO.:78 (CDR3) and light chain CDRs comprising the amino acid sequences of SEQ ID NO.:79 (CDR1), SEQ ID NO.80 (CDR2) and SEQ ID NO.:81 (CDR3). In this embodiment the antigen binding site specific for TRAILR2 is TR #8 and the antigen binding site specific for CDH17 is CDH17v1.

Preferably the antigen binding site specific for TRAILR2 comprises a heavy chain variable domain comprising the amino acid sequence of SEQ ID NO.:90 and a light chain variable domain comprising the amino acid sequence of SEQ ID NO.:91 and the antigen binding site specific for CDH17 comprises a heavy chain variable domain comprising the amino acid sequence of SEQ ID NO.:118 and a light chain variable domain comprising the amino acid sequence of SEQ ID NO.:118. In this embodiment the antigen binding site specific for TRAILR2 is TR #8 (e.g., scFv of SEQ ID NO: 138) and the antigen binding site specific for CDH17 is CDH17v1.

In a preferred embodiment of the binding molecule of the invention, the antigen binding site specific for TRAILR2 comprises heavy chain CDRs comprising the amino acid sequences of SEQ ID NO.:31 (CDR1), SEQ ID NO.:32 (CDR2) and SEQ ID NO.:33 (CDR3) and light chain CDRs comprising the amino acid sequences of SEQ ID NO.:34 (CDR1), SEQ ID NO.35 (CDR2) and SEQ ID NO.:36 (CDR3) and the antigen binding site specific for CDH17 comprises heavy chain CDRs comprising the amino acid sequences of SEQ ID NO.:58 (CDR1), SEQ ID NO.:59 (CDR2) and SEQ ID NO.:60 (CDR3) and light chain CDRs comprising the amino acid sequences of SEQ ID NO.:61 (CDR1), SEQ ID NO.62 (CDR2) and SEQ ID NO.:63 (CDR3). In this embodiment the antigen binding site specific for TRAILR2 is TR #10 and the antigen binding site specific for CDH17 is CDH17E9.

Preferably the antigen binding site specific for TRAILR2 comprises a heavy chain variable domain comprising the amino acid sequence of SEQ ID NO.:92 and a light chain variable domain comprising the amino acid sequence of SEQ ID NO.:93 and the antigen binding site specific for CDH17 comprises a heavy chain variable domain comprising the amino acid sequence of SEQ ID NO.:110 and a light chain variable domain comprising the amino acid sequence of SEQ ID NO.:111. In this embodiment the antigen binding site specific for TRAILR2 is TR #10 (e.g., scFv of SEQ ID NO: 139) and the antigen binding site specific for CDH17 is CDH17E9.

In a preferred embodiment of the binding molecule of the invention, the antigen binding site specific for TRAILR2 comprises heavy chain CDRs comprising the amino acid sequences of SEQ ID NO.:31 (CDR1), SEQ ID NO.:32 (CDR2) and SEQ ID NO.:33 (CDR3) and light chain CDRs comprising the amino acid sequences of SEQ ID NO.:34 (CDR1), SEQ ID NO.35 (CDR2) and SEQ ID NO.:36 (CDR3) and the antigen binding site specific for CDH17 comprises heavy chain CDRs comprising the amino acid sequences of SEQ ID NO.:64 (CDR1), SEQ ID NO.:65 (CDR2) and SEQ ID NO.:66 (CDR3) and light chain CDRs comprising the amino acid sequences of SEQ ID NO.:67 (CDR1), SEQ ID NO.68 (CDR2) and SEQ ID NO.:69 (CDR3). In this embodiment the antigen binding site specific for TRAILR2 is TR #10 and the antigen binding site specific for CDH17 is CDH17A6.

Preferably the antigen binding site specific for TRAILR2 comprises a heavy chain variable domain comprising the amino acid sequence of SEQ ID NO.:92 and a light chain variable domain comprising the amino acid sequence of SEQ ID NO.:93 and the antigen binding site specific for CDH17 comprises a heavy chain variable domain comprising the amino acid sequence of SEQ ID NO.:112 and a light chain variable domain comprising the amino acid sequence of SEQ ID NO.:113. In this embodiment the antigen binding site specific for TRAILR2 is TR #10 (e.g., scFv of SEQ ID NO: 139) and the antigen binding site specific for CDH17 is CDH17A6.

Preferably the antigen binding site specific for TRAILR2 comprises heavy chain CDRs comprising the amino acid sequences of SEQ ID NO.:31 (CDR1), SEQ ID NO.:32

(CDR2) and SEQ ID NO.:33 (CDR3) and light chain CDRs comprising the amino acid sequences of SEQ ID NO.:34 (CDR1), SEQ ID NO.35 (CDR2) and SEQ ID NO.:36 (CDR3) and the antigen binding site specific for CDH17 comprises heavy chain CDRs comprising the amino acid sequences of SEQ ID NO.:70 (CDR1), SEQ ID NO.:71 (CDR2) and SEQ ID NO.:72 (CDR3) and has light chain CDRs comprising the amino acid sequences of SEQ ID NO.:73 (CDR1), SEQ ID NO.74 (CDR2) and SEQ ID NO.:75 (CDR3). In this embodiment the antigen binding site specific for TRAILR2 is TR #10 and the antigen binding site specific for CDH17 is CDH17E2 or CDH17H2.

Preferably the antigen binding site specific for TRAILR2 comprises a heavy chain variable domain comprising the amino acid sequence of SEQ ID NO.:92 and a light chain variable domain comprising the amino acid sequence of SEQ ID NO.93 and the antigen binding site specific for CDH17 comprises a heavy chain variable domain comprising the amino acid sequence of SEQ ID NO.:114 and a light chain variable domain comprising the amino acid sequence of SEQ ID NO.:115. In this embodiment the antigen binding site specific for TRAILR2 is TR #10 (e.g., scFv of SEQ ID NO: 139) and the antigen binding site specific for CDH17 is CDH17E2.

Preferably the antigen binding site specific for TRAILR2 comprises a heavy chain variable domain comprising the amino acid sequence of SEQ ID NO.:92 and a light chain variable domain comprising the amino acid sequence of SEQ ID NO.:93 and the antigen binding site specific for CDH17 comprises a heavy chain variable domain comprising the amino acid sequence of SEQ ID NO.:116 and a light chain variable domain comprising the amino acid sequence of SEQ ID NO.:117. In this embodiment the antigen binding site specific for TRAILR2 is TR #10 (e.g., scFv of SEQ ID NO: 139) and the antigen binding site specific for CDH17 is CDH17H2.

Preferably the antigen binding site specific for TRAILR2 comprises heavy chain CDRs comprising the amino acid sequences of SEQ ID NO.:31 (CDR1), SEQ ID NO.:32 (CDR2) and SEQ ID NO.:33 (CDR3) and light chain CDRs comprising the amino acid sequences of SEQ ID NO.:34 (CDR1), SEQ ID NO.35 (CDR2) and SEQ ID NO.:36 (CDR3) and the antigen binding site specific for CDH17 comprises heavy chain CDRs comprising the amino acid sequences of SEQ ID NO.:76 (CDR1), SEQ ID NO.:77 (CDR2) and SEQ ID NO.:78 (CDR3) and has light chain CDRs comprising the amino acid sequences of SEQ ID NO.:79 (CDR1), SEQ ID NO.80 (CDR2) and SEQ ID NO.:81 (CDR3). In this embodiment the antigen binding site specific for TRAILR2 is TR #10 and the antigen binding site specific for CDH17 is CDH17v1.

Preferably the antigen binding site specific for TRAILR2 comprises a heavy chain variable domain comprising the amino acid sequence of SEQ ID NO.:92 and a light chain variable domain comprising the amino acid sequence of SEQ ID NO.:93 and the antigen binding site specific for CDH17 comprises a heavy chain variable domain comprising the amino acid sequence of SEQ ID NO.:118 and a light chain variable domain comprising the amino acid sequence of SEQ ID NO.:119. In this embodiment the antigen binding site specific for TRAILR2 is TR #10 (e.g., scFv of SEQ ID NO: 139) and the antigen binding site specific for CDH17 is CDH17v1.

In a preferred embodiment of the binding molecule of the invention, the antigen binding site specific for TRAILR2 comprises heavy chain CDRs comprising the amino acid sequences of SEQ ID NO.:37 (CDR1), SEQ ID NO.:38 (CDR2) and SEQ ID NO.:39 (CDR3) and light chain CDRs comprising the amino acid sequences of SEQ ID NO.:40 (CDR1), SEQ ID NO.41 (CDR2) and SEQ ID NO.:42 (CDR3) and the antigen binding site specific for CDH17 comprises heavy chain CDRs comprising the amino acid sequences of SEQ ID NO.:58 (CDR1), SEQ ID NO.:59 (CDR2) and SEQ ID NO.:60 (CDR3) and light chain CDRs comprising the amino acid sequences of SEQ ID NO.:61 (CDR1), SEQ ID NO.62 (CDR2) and SEQ ID NO.:63 (CDR3). In this embodiment the antigen binding site specific for TRAILR2 is TR #12 and the antigen binding site specific for CDH17 is CDH17E9.

Preferably the antigen binding site specific for TRAILR2 comprises a heavy chain variable domain comprising the amino acid sequence of SEQ ID NO.:94 and a light chain variable domain comprising the amino acid sequence of SEQ ID NO.:95 and the antigen binding site specific for CDH17 comprises a heavy chain variable domain comprising the amino acid sequence of SEQ ID NO.:110 and a light chain variable domain comprising the amino acid sequence of SEQ ID NO.:111. In this embodiment the antigen binding site specific for TRAILR2 is TR #12 (e.g., scFv of SEQ ID NO: 140) and the antigen binding site specific for CDH17 is CDH17E9.

In a preferred embodiment of the binding molecule of the invention, the antigen binding site specific for TRAILR2 comprises heavy chain CDRs comprising the amino acid sequences of SEQ ID NO.:37 (CDR1), SEQ ID NO.:38 (CDR2) and SEQ ID NO.:39 (CDR3) and light chain CDRs comprising the amino acid sequences of SEQ ID NO.:40 (CDR1), SEQ ID NO.41 (CDR2) and SEQ ID NO.:42 (CDR3) and the antigen binding site specific for CDH17 comprises heavy chain CDRs comprising the amino acid sequences of SEQ ID NO.:64 (CDR1), SEQ ID NO.:65 (CDR2) and SEQ ID NO.:66 (CDR3) and light chain CDRs comprising the amino acid sequences of SEQ ID NO.:67 (CDR1), SEQ ID NO.68 (CDR2) and SEQ ID NO.:69 (CDR3). In this embodiment the antigen binding site specific for TRAILR2 is TR #12 and the antigen binding site specific for CDH17 is CDH17A6.

Preferably the antigen binding site specific for TRAILR2 comprises a heavy chain variable domain comprising the amino acid sequence of SEQ ID NO.:94 and a light chain variable domain comprising the amino acid sequence of SEQ ID NO.:95 and the antigen binding site specific for CDH17 comprises a heavy chain variable domain comprising the amino acid sequence of SEQ ID NO.:112 and a light chain variable domain comprising the amino acid sequence of SEQ ID NO.:113. In this embodiment the antigen binding site specific for TRAILR2 is TR #12 (e.g., scFv of SEQ ID NO: 140) and the antigen binding site specific for CDH17 is CDH17A6.

In a preferred embodiment of the binding molecule of the invention, the antigen binding site specific for TRAILR2 comprises heavy chain CDRs comprising the amino acid sequences of SEQ ID NO.:37 (CDR1), SEQ ID NO.:38 (CDR2) and SEQ ID NO.:39 (CDR3) and light chain CDRs comprising the amino acid sequences of SEQ ID NO.:40 (CDR1), SEQ ID NO.41 (CDR2) and SEQ ID NO.:42 (CDR3) and the antigen binding site specific for CDH17 comprises heavy chain CDRs comprising the amino acid sequences of SEQ ID NO.:70 (CDR1), SEQ ID NO.:71 (CDR2) and SEQ ID NO.:72 (CDR3) and light chain CDRs comprising the amino acid sequences of SEQ ID NO.:73 (CDR1), SEQ ID NO.74 (CDR2) and SEQ ID NO.:75 (CDR3). In this embodiment the antigen binding site specific for TRAILR2 is TR #12 and the antigen binding site specific for CDH17 is CDH17IE2 or CDH17IH2.

Preferably the antigen binding site specific for TRAILR2 comprises a heavy chain variable domain comprising the amino acid sequence of SEQ ID NO.:94 and a light chain variable domain comprising the amino acid sequence of SEQ ID NO.:95 and the antigen binding site specific for CDH17 comprises a heavy chain variable domain comprising the amino acid sequence of SEQ ID NO.:114 and a light chain variable domain comprising the amino acid sequence of SEQ ID NO.:115. In this embodiment the antigen binding site specific for TRAILR2 is TR #12 (e.g., scFv of SEQ ID NO: 140) and the antigen binding site specific for CDH17 is CDH17E2.

Preferably the antigen binding site specific for TRAILR2 comprises a heavy chain variable domain comprising the amino acid sequence of SEQ ID NO.:94 and a light chain variable domain comprising the amino acid sequence of SEQ ID NO.:95 and the antigen binding site specific for CDH17 comprises a heavy chain variable domain comprising the amino acid sequence of SEQ ID NO.:116 and a light chain variable domain comprising the amino acid sequence of SEQ ID NO.:117. In this embodiment the antigen binding site specific for TRAILR2 is TR #12 (e.g., scFv of SEQ ID NO: 140) and the antigen binding site specific for CDH17 is CDH17H2.

In a preferred embodiment of the binding molecule of the invention, the antigen binding site specific for TRAILR2 comprises heavy chain CDRs comprising the amino acid sequences of SEQ ID NO.:37 (CDR1), SEQ ID NO.:38 (CDR2) and SEQ ID NO.:39 (CDR3) and light chain CDRs comprising the amino acid sequences of SEQ ID NO.:40 (CDR1), SEQ ID NO.41 (CDR2) and SEQ ID NO.:42 (CDR3) and the antigen binding site specific for CDH17 comprises heavy chain CDRs comprising the amino acid sequences of SEQ ID NO.:76 (CDR1), SEQ ID NO.:77 (CDR2) and SEQ ID NO.:78 (CDR3) and light chain CDRs comprising the amino acid sequences of SEQ ID NO.:79 (CDR1), SEQ ID NO.80 (CDR2) and SEQ ID NO.:81 (CDR3). In this embodiment the antigen binding site specific for TRAILR2 is TR #12 and the antigen binding site specific for CDH17 is CDH17v1.

Preferably the antigen binding site specific for TRAILR2 comprises a heavy chain variable domain comprising the amino acid sequence of SEQ ID NO.:94 and a light chain variable domain comprising the amino acid sequence of SEQ ID NO.:95 and the antigen binding site specific for CDH17 comprises a heavy chain variable domain comprising the amino acid sequence of SEQ ID NO.:118 and a light chain variable domain comprising the amino acid sequence of SEQ ID NO.:119. In this embodiment the antigen binding site specific for TRAILR2 is TR #12 (e.g., scFv of SEQ ID NO: 140) and the antigen binding site specific for CDH17 is CDH17v1.

In a preferred embodiment of the binding molecule of the invention, the antigen binding site specific for TRAILR2 comprises heavy chain CDRs comprising the amino acid sequences of SEQ ID NO.:43 (CDR1), SEQ ID NO.:44 (CDR2) and SEQ ID NO.:48 (CDR3) and light chain CDRs comprising the amino acid sequences of SEQ ID NO.:49 (CDR1), SEQ ID NO.50 (CDR2) and SEQ ID NO.:54 (CDR3) and the antigen binding site specific for CDH17 comprises heavy chain CDRs comprising the amino acid sequences of SEQ ID NO.:58 (CDR1), SEQ ID NO.:59 (CDR2) and SEQ ID NO.:60 (CDR3) and light chain CDRs comprising the amino acid sequences of SEQ ID NO.:61 (CDR1), SEQ ID NO.62 (CDR2) and SEQ ID NO.:63 (CDR3). In this embodiment the antigen binding site specific for TRAILR2 is TRv1 or TRv2 and the antigen binding site specific for CDH17 is CDH17E9.

Preferably the antigen binding site specific for TRAILR2 comprises a heavy chain variable domain comprising the amino acid sequence of SEQ ID NO.:96 and a light chain variable domain comprising the amino acid sequence of SEQ ID NO.:97 and the antigen binding site specific for CDH17 comprises a heavy chain variable domain comprising the amino acid sequence of SEQ ID NO.:110 and a light chain variable domain comprising the amino acid sequence of SEQ ID NO.:111. In this embodiment the antigen binding site specific for TRAILR2 is TRv1 (e.g., scFv of SEQ ID NO: 124, SEQ ID NO: 131, SEQ ID NO: 132, SEQ ID NO: 133) and the antigen binding site specific for CDH17 is CDH17E9.

Preferably the antigen binding site specific for TRAILR2 comprises a heavy chain variable domain comprising the amino acid sequence of SEQ ID NO.:98 and a light chain variable domain comprising the amino acid sequence of SEQ ID NO.:99 and the antigen binding site specific for CDH17 comprises a heavy chain variable domain comprising the amino acid sequence of SEQ ID NO.:110 and a light chain variable domain comprising the amino acid sequence of SEQ ID NO.:111. In this embodiment the antigen binding site specific for TRAILR2 is TRv2 (e.g., scFv of SEQ ID NO: 125) and the antigen binding site specific for CDH17 is CDH17E9.

In a preferred embodiment of the binding molecule of the invention, the antigen binding site specific for TRAILR2 comprises heavy chain CDRs comprising the amino acid sequences of SEQ ID NO.:43 (CDR1), SEQ ID NO.:44 (CDR2) and SEQ ID NO.:48 (CDR3) and light chain CDRs comprising the amino acid sequences of SEQ ID NO.:49 (CDR1), SEQ ID NO.50 (CDR2) and SEQ ID NO.:54 (CDR3) and the antigen binding site specific for CDH17 comprises heavy chain CDRs comprising the amino acid sequences of SEQ ID NO.:64 (CDR1), SEQ ID NO.:65 (CDR2) and SEQ ID NO.:66 (CDR3) and light chain CDRs comprising the amino acid sequences of SEQ ID NO.:67 (CDR1), SEQ ID NO.68 (CDR2) and SEQ ID NO.:69 (CDR3). In this embodiment the antigen binding site specific for TRAILR2 is TRv1 or TRv2 and the antigen binding site specific for CDH17 is CDH17A6.

Preferably the antigen binding site specific for TRAILR2 comprises a heavy chain variable domain comprising the amino acid sequence of SEQ ID NO.:96 and a light chain variable domain comprising the amino acid sequence of SEQ ID NO.:97 and the antigen binding site specific for CDH17 comprises a heavy chain variable domain comprising the amino acid sequence of SEQ ID NO.:112 and a light chain variable domain comprising the amino acid sequence of SEQ ID NO.:113. In this embodiment the antigen binding site specific for TRAILR2 is TRv1 (e.g., scFv of SEQ ID NO: 124, SEQ ID NO: 131, SEQ ID NO: 132, SEQ ID NO: 133) and the antigen binding site specific for CDH17 is CDH17A6.

Preferably the antigen binding site specific for TRAILR2 comprises a heavy chain variable domain comprising the amino acid sequence of SEQ ID NO.:98 and a light chain variable domain comprising the amino acid sequence of SEQ ID NO.:99 and the antigen binding site specific for CDH17 comprises a heavy chain variable domain comprising the amino acid sequence of SEQ ID NO.:112 and a light chain variable domain comprising the amino acid sequence of SEQ ID NO.:113. In this embodiment the antigen binding site specific for TRAILR2 is TRv2 (e.g., scFv of SEQ ID NO: 125) and the antigen binding site specific for CDH17 is CDH17A6.

In a preferred embodiment of the binding molecule of the invention, the antigen binding site specific for TRAILR2 comprises heavy chain CDRs comprising the amino acid sequences of SEQ ID NO.:43 (CDR1), SEQ ID NO.:44 (CDR2) and SEQ ID NO.:48 (CDR3) and light chain CDRs comprising the amino acid sequences of SEQ ID NO.:49 (CDR1), SEQ ID NO.50 (CDR2) and SEQ ID NO.:54 (CDR3) and the antigen binding site specific for CDH17 comprises heavy chain CDRs comprising the amino acid sequences of SEQ ID NO.:70 (CDR1), SEQ ID NO.:71 (CDR2) and SEQ ID NO.:72 (CDR3) and light chain CDRs comprising the amino acid sequences of SEQ ID NO.:73 (CDR1), SEQ ID NO.74 (CDR2) and SEQ ID NO.:75 (CDR3). In this embodiment the antigen binding site specific for TRAILR2 is TRv1 or TRv2 and the antigen binding site specific for CDH17 is CDH17E2 or CDH17H2.

Preferably the antigen binding site specific for TRAILR2 comprises a heavy chain variable domain comprising the amino acid sequence of SEQ ID NO.:96 and a light chain variable domain comprising the amino acid sequence of SEQ ID NO.:97 and the antigen binding site specific for CDH17 comprises a heavy chain variable domain comprising the amino acid sequence of SEQ ID NO.:114 and a light chain variable domain comprising the amino acid sequence of SEQ ID NO.:115. In this embodiment the antigen binding site specific for TRAILR2 is TRv1 (e.g., scFv of SEQ ID NO: 124, SEQ ID NO: 131, SEQ ID NO: 132, SEQ ID NO: 133) and the antigen binding site specific for CDH17 is CDH17E2.

Preferably the antigen binding site specific for TRAILR2 comprises a heavy chain variable domain comprising the amino acid sequence of SEQ ID NO.:98 and a light chain variable domain comprising the amino acid sequence of SEQ ID NO.:99 and the antigen binding site specific for CDH17 comprises a heavy chain variable domain comprising the amino acid sequence of SEQ ID NO.:114 and a light chain variable domain comprising the amino acid sequence of SEQ ID NO.:115. In this embodiment the antigen binding site specific for TRAILR2 is TRv2 (e.g., scFv of SEQ ID NO: 125) and the antigen binding site specific for CDH17 is CDH17E2.

Preferably the antigen binding site specific for TRAILR2 comprises a heavy chain variable domain comprising the amino acid sequence of SEQ ID NO.:96 and a light chain variable domain comprising the amino acid sequence of SEQ ID NO.:97 and the antigen binding site specific for CDH17 comprises a heavy chain variable domain comprising the amino acid sequence of SEQ ID NO.:116 and a light chain variable domain comprising the amino acid sequence of SEQ ID NO.:117. In this embodiment the antigen binding site specific for TRAILR2 is TRv1 (e.g., scFv of SEQ ID NO: 124, SEQ ID NO: 131, SEQ ID NO: 132, SEQ ID NO: 133) and the antigen binding site specific for CDH17 is CDH17H2.

Preferably the antigen binding site specific for TRAILR2 comprises a heavy chain variable domain comprising the amino acid sequence of SEQ ID NO.:98 and a light chain variable domain comprising the amino acid sequence of SEQ ID NO.:99 and the antigen binding site specific for CDH17 comprises a heavy chain variable domain comprising the amino acid sequence of SEQ ID NO.:116 and a light chain variable domain comprising the amino acid sequence of SEQ ID NO.:117. In this embodiment the antigen binding site specific for TRAILR2 is TRv2 (e.g., scFv of SEQ ID NO: 125) and the antigen binding site specific for CDH17 is CDH17H2.

In a preferred embodiment of the binding molecule of the invention, the antigen binding site specific for TRAILR2 comprises heavy chain CDRs comprising the amino acid sequences of SEQ ID NO.:43 (CDR1), SEQ ID NO.:44 (CDR2) and SEQ ID NO.:48 (CDR3) and light chain CDRs comprising the amino acid sequences of SEQ ID NO.:49 (CDR1), SEQ ID NO.50 (CDR2) and SEQ ID NO.:54 (CDR3) and the antigen binding site specific for CDH17 comprises heavy chain CDRs comprising the amino acid sequences of SEQ ID NO.:76 (CDR1), SEQ ID NO.:77 (CDR2) and SEQ ID NO.:78 (CDR3) and light chain CDRs comprising the amino acid sequences of SEQ ID NO.:79 (CDR1), SEQ ID NO.80 (CDR2) and SEQ ID NO.:81 (CDR3). In this embodiment the antigen binding site specific for TRAILR2 is TRv1 or TRv2 and the antigen binding site specific for CDH17 is CDH17v1.

Preferably the antigen binding site specific for TRAILR2 comprises a heavy chain variable domain comprising the amino acid sequence of SEQ ID NO.:96 and a light chain variable domain comprising the amino acid sequence of SEQ ID NO.:97 and the antigen binding site specific for CDH17 comprises a heavy chain variable domain comprising the amino acid sequence of SEQ ID NO.:118 and a light chain variable domain comprising the amino acid sequence of SEQ ID NO.:119. In this embodiment the antigen binding site specific for TRAILR2 is TRv1 (e.g., scFv of SEQ ID NO: 124, SEQ ID NO: 131, SEQ ID NO: 132, SEQ ID NO: 133) and the antigen binding site specific for CDH17 is CDH17v1.

Preferably the antigen binding site specific for TRAILR2 comprises a heavy chain variable domain comprising the amino acid sequence of SEQ ID NO.:98 and a light chain variable domain comprising the amino acid sequence of SEQ ID NO.:99 and the antigen binding site specific for CDH17 comprises a heavy chain variable domain comprising the amino acid sequence of SEQ ID NO.:118 and a light chain variable domain comprising the amino acid sequence of SEQ ID NO.:119. In this embodiment the antigen binding site specific for TRAILR2 is TRv2 (e.g., scFv of SEQ ID NO: 125) and the antigen binding site specific for CDH17 is CDH17v1.

In a preferred embodiment of the binding molecule of the invention, the antigen binding site specific for TRAILR2 comprises heavy chain CDRs comprising the amino acid sequences of SEQ ID NO.:43 (CDR1), SEQ ID NO.:45 (CDR2) and SEQ ID NO.:48 (CDR3) and light chain CDRs comprising the amino acid sequences of SEQ ID NO.:49 (CDR1), SEQ ID NO.51 (CDR2) and SEQ ID NO:55 (CDR3) and the antigen binding site specific for CDH17 comprises heavy chain CDRs comprising the amino acid sequences of SEQ ID NO.:58 (CDR1), SEQ ID NO.:59 (CDR2) and SEQ ID NO.:60 (CDR3) and light chain CDRs comprising the amino acid sequences of SEQ ID NO.:61 (CDR1), SEQ ID NO.62 (CDR2) and SEQ ID NO.:63 (CDR3). In this embodiment the antigen binding site specific for TRAILR2 is TRv3 and the antigen binding site specific for CDH17 is CDH17E9.

Preferably the antigen binding site specific for TRAILR2 comprises a heavy chain variable domain comprising the amino acid sequence of SEQ ID NO.:100 and a light chain variable domain comprising the amino acid sequence of SEQ ID NO.:101 and the antigen binding site specific for CDH17 comprises a heavy chain variable domain comprising the amino acid sequence of SEQ ID NO.:110 and a light chain variable domain comprising the amino acid sequence of SEQ ID NO.:111. In this embodiment the antigen binding site specific for TRAILR2 is TRv3 (e.g., scFv of SEQ ID NO: 126) and the antigen binding site specific for CDH17 is CDH17E9.

In a preferred embodiment of the binding molecule of the invention, the antigen binding site specific for TRAILR2 comprises heavy chain CDRs comprising the amino acid sequences of SEQ ID NO.:43 (CDR1), SEQ ID NO.:45 (CDR2) and SEQ ID NO.:48 (CDR3) and light chain CDRs comprising the amino acid sequences of SEQ ID NO.:49 (CDR1), SEQ ID NO.51 (CDR2) and SEQ ID NO:55 (CDR3) and the antigen binding site specific for CDH17 comprises heavy chain CDRs comprising the amino acid sequences of SEQ ID NO.:64 (CDR1), SEQ ID NO.:65 (CDR2) and SEQ ID NO.:66 (CDR3) and light chain CDRs comprising the amino acid sequences of SEQ ID NO.:67 (CDR1), SEQ ID NO.68 (CDR2) and SEQ ID NO.:69 (CDR3). In this embodiment the antigen binding site specific for TRAILR2 is TRv3 and the antigen binding site specific for CDH17 is CDH17A6.

Preferably the antigen binding site specific for TRAILR2 comprises a heavy chain variable domain comprising the amino acid sequence of SEQ ID NO.:100 and a light chain variable domain comprising the amino acid sequence of SEQ ID NO.:101 and the antigen binding site specific for CDH17 comprises a heavy chain variable domain comprising the amino acid sequence of SEQ ID NO.:112 and a light chain variable domain comprising the amino acid sequence of SEQ ID NO.:113. In this embodiment the antigen binding site specific for TRAILR2 is TRv3 (e.g., scFv of SEQ ID NO: 126) and the antigen binding site specific for CDH17 is CDH17A6.

In a preferred embodiment of the binding molecule of the invention, the antigen binding site specific for TRAILR2 comprises heavy chain CDRs comprising the amino acid sequences of SEQ ID NO.:43 (CDR1), SEQ ID NO.:45 (CDR2) and SEQ ID NO.:48 (CDR3) and light chain CDRs comprising the amino acid sequences of SEQ ID NO.:49 (CDR1), SEQ ID NO.51 (CDR2) and SEQ ID NO:55 (CDR3) and the antigen binding site specific for CDH17 comprises heavy chain CDRs comprising the amino acid sequences of SEQ ID NO.:70 (CDR1), SEQ ID NO.:71 (CDR2) and SEQ ID NO.:72 (CDR3) and light chain CDRs comprising the amino acid sequences of SEQ ID NO.:73 (CDR1), SEQ ID NO.74 (CDR2) and SEQ ID NO.:75 (CDR3). In this embodiment the antigen binding site specific for TRAILR2 is TRv3 and the antigen binding site specific for CDH17 is CDH17E2 or CDH17H2.

Preferably the antigen binding site specific for TRAILR2 comprises a heavy chain variable domain comprising the amino acid sequence of SEQ ID NO.:100 and a light chain variable domain comprising the amino acid sequence of SEQ ID NO.:101 and the antigen binding site specific for CDH17 comprises a heavy chain variable domain comprising the amino acid sequence of SEQ ID NO.:114 and a light chain variable domain comprising the amino acid sequence of SEQ ID NO.:115. In this embodiment the antigen binding site specific for TRAILR2 is TRv3 (e.g., scFv of SEQ ID NO: 126) and the antigen binding site specific for CDH17 is CDH17E2.

Preferably the antigen binding site specific for TRAILR2 comprises a heavy chain variable domain comprising the amino acid sequence of SEQ ID NO.:100 and a light chain variable domain comprising the amino acid sequence of SEQ ID NO.:101 and the antigen binding site specific for CDH17 comprises a heavy chain variable domain comprising the amino acid sequence of SEQ ID NO.:116 and a light chain variable domain comprising the amino acid sequence of SEQ ID NO.:117. In this embodiment the antigen binding site specific for TRAILR2 is TRv3 (e.g., scFv of SEQ ID NO: 126) and the antigen binding site specific for CDH17 is CDH17H2.

In a preferred embodiment of the binding molecule of the invention, the antigen binding site specific for TRAILR2 comprises heavy chain CDRs comprising the amino acid sequences of SEQ ID NO.:43 (CDR1), SEQ ID NO.:45 (CDR2) and SEQ ID NO.:48 (CDR3) and light chain CDRs comprising the amino acid sequences of SEQ ID NO.:49 (CDR1), SEQ ID NO.51 (CDR2) and SEQ ID NO:55 (CDR3) and the antigen binding site specific for CDH17 comprises heavy chain CDRs comprising the amino acid sequences of SEQ ID NO.:76 (CDR1), SEQ ID NO.:77 (CDR2) and SEQ ID NO.:78 (CDR3) and light chain CDRs comprising the amino acid sequences of SEQ ID NO.:79 (CDR1), SEQ ID NO.80 (CDR2) and SEQ ID NO.:81 (CDR3). In this embodiment the antigen binding site specific for TRAILR2 is TRv3 and the antigen binding site specific for CDH17 is CDH17v1.

Preferably the antigen binding site specific for TRAILR2 comprises a heavy chain variable domain comprising the amino acid sequence of SEQ ID NO.:100 and a light chain variable domain comprising the amino acid sequence of SEQ ID NO.:101 and the antigen binding site specific for CDH17 comprises a heavy chain variable domain comprising the amino acid sequence of SEQ ID NO.:118 and a light chain variable domain comprising the amino acid sequence of SEQ ID NO.:119. In this embodiment the antigen binding site specific for TRAILR2 is TRv3 (e.g., scFv of SEQ ID NO: 126) and the antigen binding site specific for CDH17 is CDH17v1.

In a preferred embodiment of the binding molecule of the invention, the antigen binding site specific for TRAILR2 comprises heavy chain CDRs comprising the amino acid sequences of SEQ ID NO.:43 (CDR1), SEQ ID NO.:45 (CDR2) and SEQ ID NO.:48 (CDR3) and light chain CDRs comprising the amino acid sequences of SEQ ID NO.:49 (CDR1), SEQ ID NO.52 (CDR2) and SEQ ID NO.:56 (CDR3) and the antigen binding site specific for CDH17 comprises heavy chain CDRs comprising the amino acid sequences of SEQ ID NO.:58 (CDR1), SEQ ID NO.:59 (CDR2) and SEQ ID NO.:60 (CDR3) and light chain CDRs comprising the amino acid sequences of SEQ ID NO.:61 (CDR1), SEQ ID NO.62 (CDR2) and SEQ ID NO.:63 (CDR3). In this embodiment the antigen binding site specific for TRAILR2 is TRv4 and the antigen binding site specific for CDH17 is CDH17E9.

Preferably the antigen binding site specific for TRAILR2 comprises a heavy chain variable domain comprising the amino acid sequence of SEQ ID NO.:102 and a light chain variable domain comprising the amino acid sequence of SEQ ID NO.:103 and the antigen binding site specific for CDH17 comprises a heavy chain variable domain comprising the amino acid sequence of SEQ ID NO.:110 and a light chain variable domain comprising the amino acid sequence of SEQ ID NO.:111. In this embodiment the antigen binding site specific for TRAILR2 is TRv4 (e.g., scFv of SEQ ID NO: 127) and the antigen binding site specific for CDH17 is CDH17E9.

In a preferred embodiment of the binding molecule of the invention, the antigen binding site specific for TRAILR2 comprises heavy chain CDRs comprising the amino acid sequences of SEQ ID NO.:43 (CDR1), SEQ ID NO.:45 (CDR2) and SEQ ID NO.:48 (CDR3) and light chain CDRs comprising the amino acid sequences of SEQ ID NO.:49 (CDR1), SEQ ID NO.52 (CDR2) and SEQ ID NO.:56 (CDR3) and the antigen binding site specific for CDH17 comprises heavy chain CDRs comprising the amino acid sequences of SEQ ID NO.:64 (CDR1), SEQ ID NO.:65 (CDR2) and SEQ ID NO.:66 (CDR3) and light chain CDRs comprising the amino acid sequences of SEQ ID NO.:67 (CDR1), SEQ ID NO.68 (CDR2) and SEQ ID NO.:69 (CDR3). In this embodiment the antigen binding site specific for TRAILR2 is TRv4 and the antigen binding site specific for CDH17 is CDH17A6.

Preferably the antigen binding site specific for TRAILR2 comprises a heavy chain variable domain comprising the amino acid sequence of SEQ ID NO.:102 and a light chain variable domain comprising the amino acid sequence of SEQ ID NO.:103 and the antigen binding site specific for CDH17 comprises a heavy chain variable domain comprising the amino acid sequence of SEQ ID NO.:112 and a light chain variable domain comprising the amino acid sequence of SEQ ID NO.:113. In this embodiment the antigen binding site specific for TRAILR2 is TRv4 (e.g., scFv of SEQ ID NO: 127) and the antigen binding site specific for CDH17 is CDH17A6.

In a preferred embodiment of the binding molecule of the invention, the antigen binding site specific for TRAILR2 comprises heavy chain CDRs comprising the amino acid sequences of SEQ ID NO.:43 (CDR1), SEQ ID NO.:45 (CDR2) and SEQ ID NO.:48 (CDR3) and light chain CDRs comprising the amino acid sequences of SEQ ID NO.:49 (CDR1), SEQ ID NO.52 (CDR2) and SEQ ID NO.:56 (CDR3) and the antigen binding site specific for CDH17 comprises heavy chain CDRs comprising the amino acid sequences of SEQ ID NO.:70 (CDR1), SEQ ID NO.:71 (CDR2) and SEQ ID NO.:72 (CDR3) and light chain CDRs comprising the amino acid sequences of SEQ ID NO.:73 (CDR1), SEQ ID NO.74 (CDR2) and SEQ ID NO.:75 (CDR3). In this embodiment the antigen binding site specific for TRAILR2 is TRv4 and the antigen binding site specific for CDH17 is CDH17E2 or CDH17H2.

Preferably the antigen binding site specific for TRAILR2 comprises a heavy chain variable domain comprising the amino acid sequence of SEQ ID NO.:102 and a light chain variable domain comprising the amino acid sequence of SEQ ID NO.:103 and the antigen binding site specific for CDH17 comprises a heavy chain variable domain comprising the amino acid sequence of SEQ ID NO.:114 and a light chain variable domain comprising the amino acid sequence of SEQ ID NO.:115. In this embodiment the antigen binding site specific for TRAILR2 is TRv4 (e.g., scFv of SEQ ID NO: 127) and the antigen binding site specific for CDH17 is CDH17E2.

Preferably the antigen binding site specific for TRAILR2 comprises a heavy chain variable domain comprising the amino acid sequence of SEQ ID NO.:102 and a light chain variable domain comprising the amino acid sequence of SEQ ID NO.:103 and the antigen binding site specific for CDH17 comprises a heavy chain variable domain comprising the amino acid sequence of SEQ ID NO.:116 and a light chain variable domain comprising the amino acid sequence of SEQ ID NO.:117. In this embodiment the antigen binding site specific for TRAILR2 is TRv4 (e.g., scFv of SEQ ID NO: 127) and the antigen binding site specific for CDH17 is CDH17H2.

In a preferred embodiment of the binding molecule of the invention, the antigen binding site specific for TRAILR2 comprises heavy chain CDRs comprising the amino acid sequences of SEQ ID NO.:43 (CDR1), SEQ ID NO.:45 (CDR2) and SEQ ID NO.:48 (CDR3) and light chain CDRs comprising the amino acid sequences of SEQ ID NO.:49 (CDR1), SEQ ID NO.52 (CDR2) and SEQ ID NO.:56 (CDR3) and the antigen binding site specific for CDH17 comprises heavy chain CDRs comprising the amino acid sequences of SEQ ID NO.:76 (CDR1), SEQ ID NO.:77 (CDR2) and SEQ ID NO.:78 (CDR3) and light chain CDRs comprising the amino acid sequences of SEQ ID NO.:79 (CDR1), SEQ ID NO.80 (CDR2) and SEQ ID NO.:81 (CDR3). In this embodiment the antigen binding site specific for TRAILR2 is TRv4 and the antigen binding site specific for CDH17 is CDH17v1.

Preferably the antigen binding site specific for TRAILR2 comprises a heavy chain variable domain comprising the amino acid sequence of SEQ ID NO.:102 and a light chain variable domain comprising the amino acid sequence of SEQ ID NO.:103 and the antigen binding site specific for CDH17 comprises a heavy chain variable domain comprising the amino acid sequence of SEQ ID NO.:118 and a light chain variable domain comprising the amino acid sequence of SEQ ID NO.:119. In this embodiment the antigen binding site specific for TRAILR2 is TRv4 (e.g., scFv of SEQ ID NO: 127) and the antigen binding site specific for CDH17 is CDH17v1.

In a preferred embodiment of the binding molecule of the invention, the antigen binding site specific for TRAILR2 comprises heavy chain CDRs comprising the amino acid sequences of SEQ ID NO.:43 (CDR1), SEQ ID NO.:45 (CDR2) and SEQ ID NO.:48 (CDR3) and light chain CDRs comprising the amino acid sequences of SEQ ID NO.:49 (CDR1), SEQ ID NO.50 (CDR2) and SEQ ID NO.:56 (CDR3) and the antigen binding site specific for CDH17 comprises heavy chain CDRs comprising the amino acid sequences of SEQ ID NO.:58 (CDR1) SEQ ID NO.:59 (CDR2) and SEQ ID NO.:60 (CDR3) and light chain CDRs comprising the amino acid sequences of SEQ ID NO.:61 (CDR1), SEQ ID NO.62 (CDR2) and SEQ ID NO.:63 (CDR3). In this embodiment the antigen binding site specific for TRAILR2 is TRv5 and the antigen binding site specific for CDH17 is CDH17E9.

Preferably the antigen binding site specific for TRAILR2 comprises a heavy chain variable domain comprising the amino acid sequence of SEQ ID NO.:104 and a light chain variable domain comprising the amino acid sequence of SEQ ID NO.:105 and the antigen binding site specific for CDH17 comprises a heavy chain variable domain comprising the amino acid sequence of SEQ ID NO.:110 and a light chain variable domain comprising the amino acid sequence of SEQ ID NO.:111. In this embodiment the antigen binding site specific for TRAILR2 is TRv5 (e.g., scFv of SEQ ID NO: 128) and the antigen binding site specific for CDH17 is CDH17E9.

In a preferred embodiment of the binding molecule of the invention, the antigen binding site specific for TRAILR2 comprises heavy chain CDRs comprising the amino acid sequences of SEQ ID NO.:43 (CDR1), SEQ ID NO.:45 (CDR2) and SEQ ID NO.:48 (CDR3) and light chain CDRs comprising the amino acid sequences of SEQ ID NO.:49 (CDR1), SEQ ID NO.50 (CDR2) and SEQ ID NO.:56 (CDR3) and the antigen binding site specific for CDH17 comprises heavy chain CDRs comprising the amino acid sequences of SEQ ID NO.:64 (CDR1) SEQ ID NO.:65 (CDR2) and SEQ ID NO.:66 (CDR3) and light chain CDRs comprising the amino acid sequences of SEQ ID NO.:67 (CDR1), SEQ ID NO.68 (CDR2) and SEQ ID NO.:69 (CDR3). In this embodiment the antigen binding site specific for TRAILR2 is TRv5 and the antigen binding site specific for CDH17 is CDH17A6.

Preferably the antigen binding site specific for TRAILR2 comprises a heavy chain variable domain comprising the amino acid sequence of SEQ ID NO.:104 and a light chain variable domain comprising the amino acid sequence of SEQ ID NO.:105 and the antigen binding site specific for CDH17 comprises a heavy chain variable domain comprising the amino acid sequence of SEQ ID NO.:112 and a light chain variable domain comprising the amino acid sequence of SEQ ID NO.:113. In this embodiment the antigen binding site specific for TRAILR2 is TRv5 (e.g., scFv of SEQ ID NO: 128) and the antigen binding site specific for CDH17 is CDH17A6.

In a preferred embodiment of the binding molecule of the invention, the antigen binding site specific for TRAILR2 comprises heavy chain CDRs comprising the amino acid sequences of SEQ ID NO.:43 (CDR1), SEQ ID NO.:45 (CDR2) and SEQ ID NO.:48 (CDR3) and light chain CDRs comprising the amino acid sequences of SEQ ID NO.:49 (CDR1), SEQ ID NO.50 (CDR2) and SEQ ID NO.:56 (CDR3) and the antigen binding site specific for CDH17 comprises heavy chain CDRs comprising the amino acid sequences of SEQ ID NO.:70 (CDR1), SEQ ID NO.:71 (CDR2) and SEQ ID NO.:72 (CDR3) and light chain CDRs comprising the amino acid sequences of SEQ ID NO.:73 (CDR1), SEQ ID NO.74 (CDR2) and SEQ ID NO.:75 (CDR3). In this embodiment the antigen binding site specific for TRAILR2 is TRv5 and the antigen binding site specific for CDH17 is CDH17E2 or CDH17H2.

Preferably the antigen binding site specific for TRAILR2 comprises a heavy chain variable domain comprising the amino acid sequence of SEQ ID NO.:104 and a light chain variable domain comprising the amino acid sequence of SEQ ID NO.:105 and the antigen binding site specific for CDH17 comprises a heavy chain variable domain comprising the amino acid sequence of SEQ ID NO.:114 and a light chain variable domain comprising the amino acid sequence of SEQ ID NO.:115. In this embodiment the antigen binding site specific for TRAILR2 is TRv5 (e.g., scFv of SEQ ID NO: 128) and the antigen binding site specific for CDH17 is CDH17E2.

Preferably the antigen binding site specific for TRAILR2 comprises a heavy chain variable domain comprising the amino acid sequence of SEQ ID NO.:104 and a light chain variable domain comprising the amino acid sequence of SEQ ID NO.:105 and the antigen binding site specific for CDH17 comprises a heavy chain variable domain comprising the amino acid sequence of SEQ ID NO.:116 and a light chain variable domain comprising the amino acid sequence of SEQ ID NO.:117. In this embodiment the antigen binding site specific for TRAILR2 is TRv5 (e.g., scFv of SEQ ID NO: 128) and the antigen binding site specific for CDH17 is CDH17H2.

In a preferred embodiment of the binding molecule of the invention, the antigen binding site specific for TRAILR2 comprises heavy chain CDRs comprising the amino acid sequences of SEQ ID NO.:43 (CDR1), SEQ ID NO.:45 (CDR2) and SEQ ID NO.:48 (CDR3) and light chain CDRs comprising the amino acid sequences of SEQ ID NO.:49 (CDR1), SEQ ID NO.50 (CDR2) and SEQ ID NO.:56 (CDR3) and the antigen binding site specific for CDH17 comprises heavy chain CDRs comprising the amino acid sequences of SEQ ID NO.:76 (CDR1), SEQ ID NO.:77 (CDR2) and SEQ ID NO.:78 (CDR3) and light chain CDRs comprising the amino acid sequences of SEQ ID NO.:79 (CDR1), SEQ ID NO.80 (CDR2) and SEQ ID NO.:81 (CDR3). In this embodiment the antigen binding site specific for TRAILR2 is TRv5 and the antigen binding site specific for CDH17 is CDH17v1.

Preferably the antigen binding site specific for TRAILR2 comprises a heavy chain variable domain comprising the amino acid sequence of SEQ ID NO.:104 and a light chain variable domain comprising the amino acid sequence of SEQ ID NO.:105 and the antigen binding site specific for CDH17 comprises a heavy chain variable domain comprising the amino acid sequence of SEQ ID NO.:118 and a light chain variable domain comprising the amino acid sequence of SEQ ID NO.:119. In this embodiment the antigen binding site specific for TRAILR2 is TRv5 (e.g., scFv of SEQ ID NO: 128) and the antigen binding site specific for CDH17 is CDH17v1.

In a preferred embodiment of the binding molecule of the invention, the antigen binding site specific for TRAILR2 comprises heavy chain CDRs comprising the amino acid sequences of SEQ ID NO.:43 (CDR1), SEQ ID NO.:46 (CDR2) and SEQ ID NO.:48 (CDR3) and light chain CDRs comprising the amino acid sequences of SEQ ID NO.:49 (CDR1), SEQ ID NO.51 (CDR2) and SEQ ID NO.:57 (CDR3) and the antigen binding site specific for CDH17 comprises heavy chain CDRs comprising the amino acid sequences of SEQ ID NO.:58 (CDR1) SEQ ID NO.:59 (CDR2) and SEQ ID NO.:60 (CDR3) and light chain CDRs comprising the amino acid sequences of SEQ ID NO.:61 (CDR1), SEQ ID NO.62 (CDR2) and SEQ ID NO.:63 (CDR3). In this embodiment the antigen binding site specific for TRAILR2 is TRv6 and the antigen binding site specific for CDH17 is CDH17E9.

Preferably the antigen binding site specific for TRAILR2 comprises a heavy chain variable domain comprising the amino acid sequence of SEQ ID NO.:106 and a light chain variable domain comprising the amino acid sequence of SEQ ID NO.:107 and the antigen binding site specific for CDH17 comprises a heavy chain variable domain comprising the amino acid sequence of SEQ ID NO.:110 and a light chain variable domain comprising the amino acid sequence of SEQ ID NO.:111. In this embodiment the antigen binding site specific for TRAILR2 is TRv6 (e.g., scFv of SEQ ID NO: 129) and the antigen binding site specific for CDH17 is CDH17E9.

In a preferred embodiment of the binding molecule of the invention, the antigen binding site specific for TRAILR2 comprises heavy chain CDRs comprising the amino acid sequences of SEQ ID NO.:43 (CDR1), SEQ ID NO.:46 (CDR2) and SEQ ID NO.:48 (CDR3) and light chain CDRs comprising the amino acid sequences of SEQ ID NO.:49 (CDR1), SEQ ID NO.51 (CDR2) and SEQ ID NO.:57 (CDR3) and the antigen binding site specific for CDH17 comprises heavy chain CDRs comprising the amino acid sequences of SEQ ID NO.:64 (CDR1) SEQ ID NO.:65 (CDR2) and SEQ ID NO.:66 (CDR3) and light chain CDRs comprising the amino acid sequences of SEQ ID NO.:67 (CDR1), SEQ ID NO.68 (CDR2) and SEQ ID NO.:69 (CDR3). In this embodiment the antigen binding site specific for TRAILR2 is TRv6 and the antigen binding site specific for CDH17 is CDH17A6.

Preferably the antigen binding site specific for TRAILR2 comprises a heavy chain variable domain comprising the amino acid sequence of SEQ ID NO.:106 and a light chain variable domain comprising the amino acid sequence of SEQ ID NO.:107 and the antigen binding site specific for CDH17 comprises a heavy chain variable domain comprising the amino acid sequence of SEQ ID NO.:112 and a light chain variable domain comprising the amino acid sequence of SEQ ID NO.:113. In this embodiment the antigen binding site specific for TRAILR2 is TRv6 (e.g., scFv of SEQ ID NO: 129) and the antigen binding site specific for CDH17 is CDH17A6.

In a preferred embodiment of the binding molecule of the invention, the antigen binding site specific for TRAILR2 comprises heavy chain CDRs comprising the amino acid sequences of SEQ ID NO.:43 (CDR1), SEQ ID NO.:46 (CDR2) and SEQ ID NO.:48 (CDR3) and light chain CDRs comprising the amino acid sequences of SEQ ID NO.:49 (CDR1), SEQ ID NO.51 (CDR2) and SEQ ID NO.:57 (CDR3) and the antigen binding site specific for CDH17 comprises heavy chain CDRs comprising the amino acid sequences of SEQ ID NO.:70 (CDR1), SEQ ID NO.:71 (CDR2) and SEQ ID NO.:72 (CDR3) and light chain CDRs comprising the amino acid sequences of SEQ ID NO.:73 (CDR1), SEQ ID NO.74 (CDR2) and SEQ ID NO.:75 (CDR3). In this embodiment the antigen binding site specific for TRAILR2 is TRv6 and the antigen binding site specific for CDH17 is CDH17E2 or CDH17H2.

Preferably the antigen binding site specific for TRAILR2 comprises a heavy chain variable domain comprising the amino acid sequence of SEQ ID NO.:106 and a light chain variable domain comprising the amino acid sequence of SEQ ID NO.:107 and the antigen binding site specific for CDH17 comprises a heavy chain variable domain comprising the amino acid sequence of SEQ ID NO.:114 and a light chain variable domain comprising the amino acid sequence of SEQ ID NO.:115. In this embodiment the antigen binding site specific for TRAILR2 is TRv6 (e.g., scFv of SEQ ID NO: 129) and the antigen binding site specific for CDH17 is CDH17E2.

Preferably the antigen binding site specific for TRAILR2 comprises a heavy chain variable domain comprising the amino acid sequence of SEQ ID NO.:106 and a light chain variable domain comprising the amino acid sequence of SEQ ID NO.:107 and the antigen binding site specific for CDH17 comprises a heavy chain variable domain comprising the amino acid sequence of SEQ ID NO.:116 and a light chain variable domain comprising the amino acid sequence of SEQ ID NO.:117. In this embodiment the antigen binding site specific for TRAILR2 is TRv6 (e.g., scFv of SEQ ID NO: 129) and the antigen binding site specific for CDH17 is CDH17H2.

In a preferred embodiment of the binding molecule of the invention, the antigen binding site specific for TRAILR2 comprises heavy chain CDRs comprising the amino acid sequences of SEQ ID NO.:43 (CDR1), SEQ ID NO.:46 (CDR2) and SEQ ID NO.:48 (CDR3) and light chain CDRs comprising the amino acid sequences of SEQ ID NO.:49 (CDR1), SEQ ID NO.51 (CDR2) and SEQ ID NO.:57 (CDR3) and the antigen binding site specific for CDH17 comprises heavy chain CDRs comprising the amino acid sequences of SEQ ID NO.:76 (CDR1), SEQ ID NO.:77 (CDR2) and SEQ ID NO.:78 (CDR3) and light chain CDRs comprising the amino acid sequences of SEQ ID NO.:79 (CDR1), SEQ ID NO.80 (CDR2) and SEQ ID NO.:81 (CDR3). In this embodiment the antigen binding site specific for TRAILR2 is TRv6 and the antigen binding site specific for CDH17 is CDH17v1.

Preferably the antigen binding site specific for TRAILR2 comprises a heavy chain variable domain comprising the amino acid sequence of SEQ ID NO.:106 and a light chain variable domain comprising the amino acid sequence of SEQ ID NO.:107 and the antigen binding site specific for CDH17 comprises a heavy chain variable domain comprising the amino acid sequence of SEQ ID NO.:118 and a light chain variable domain comprising the amino acid sequence of SEQ ID NO.:119. In this embodiment the antigen binding site specific for TRAILR2 is TRv6 (e.g., scFv of SEQ ID NO: 129) and the antigen binding site specific for CDH17 is CDH17v1.

In a preferred embodiment of the binding molecule of the invention, the antigen binding site specific for TRAILR2 comprises heavy chain CDRs comprising the amino acid sequences of SEQ ID NO.:43 (CDR1), SEQ ID NO.:47 (CDR2) and SEQ ID NO.:48 (CDR3) and light chain CDRs comprising the amino acid sequences of SEQ ID NO.:49 (CDR1), SEQ ID NO.53 (CDR2) and SEQ ID NO.:57 (CDR3) and the antigen binding site specific for CDH17 comprises heavy chain CDRs comprising the amino acid sequences of SEQ ID NO.:58 (CDR1) SEQ ID NO.:59 (CDR2) and SEQ ID NO.:60 (CDR3) and light chain CDRs comprising the amino acid sequences of SEQ ID NO.:61 (CDR1), SEQ ID NO.62 (CDR2) and SEQ ID NO.:63 (CDR3). In this embodiment the antigen binding site specific for TRAILR2 is TRv7 and the antigen binding site specific for CDH17 is CDH17E9.

Preferably the antigen binding site specific for TRAILR2 comprises a heavy chain variable domain comprising the amino acid sequence of SEQ ID NO.:108 and a light chain variable domain comprising the amino acid sequence of SEQ ID NO.:109 and the antigen binding site specific for CDH17 comprises a heavy chain variable domain comprising the amino acid sequence of SEQ ID NO.:110 and a light chain variable domain comprising the amino acid sequence of SEQ ID NO.:111. In this embodiment the antigen binding site specific for TRAILR2 is TRv7 (e.g., scFv of SEQ ID NO: 130) and the antigen binding site specific for CDH17 is CDH17E9.

In a preferred embodiment of the binding molecule of the invention, the antigen binding site specific for TRAILR2 comprises heavy chain CDRs comprising the amino acid sequences of SEQ ID NO.:43 (CDR1), SEQ ID NO.:47 (CDR2) and SEQ ID NO.:48 (CDR3) and light chain CDRs comprising the amino acid sequences of SEQ ID NO.:49 (CDR1), SEQ ID NO.53 (CDR2) and SEQ ID NO.:57 (CDR3) and the antigen binding site specific for CDH17 comprises heavy chain CDRs comprising the amino acid sequences of SEQ ID NO.:64 (CDR1) SEQ ID NO.:65 (CDR2) and SEQ ID NO.:66 (CDR3) and light chain CDRs comprising the amino acid sequences of SEQ ID NO.:67 (CDR1), SEQ ID NO.68 (CDR2) and SEQ ID NO.:69 (CDR3). In this embodiment the antigen binding site specific for TRAILR2 is TRv7 and the antigen binding site specific for CDH17 is CDH17A6.

Preferably the antigen binding site specific for TRAILR2 comprises a heavy chain variable domain comprising the amino acid sequence of SEQ ID NO.:108 and a light chain variable domain comprising the amino acid sequence of SEQ ID NO.:109 and the antigen binding site specific for CDH17 comprises a heavy chain variable domain comprising the amino acid sequence of SEQ ID NO.:112 and a light chain variable domain comprising the amino acid sequence of SEQ ID NO.:113. In this embodiment the antigen binding site specific for TRAILR2 is TRv7 (e.g., scFv of SEQ ID NO: 130) and the antigen binding site specific for CDH17 is CDH17A6.

In a preferred embodiment of the binding molecule of the invention, the antigen binding site specific for TRAILR2 comprises heavy chain CDRs comprising the amino acid sequences of SEQ ID NO.:43 (CDR1), SEQ ID NO.:47 (CDR2) and SEQ ID NO.:48 (CDR3) and light chain CDRs comprising the amino acid sequences of SEQ ID NO.:49

(CDR1), SEQ ID NO.53 (CDR2) and SEQ ID NO.:57 (CDR3) and the antigen binding site specific for CDH17 comprises heavy chain CDRs comprising the amino acid sequences of SEQ ID NO.:70 (CDR1), SEQ ID NO.:71 (CDR2) and SEQ ID NO.:72 (CDR3) and light chain CDRs comprising the amino acid sequences of SEQ ID NO.:73 (CDR1), SEQ ID NO.74 (CDR2) and SEQ ID NO.:75 (CDR3). In this embodiment the antigen binding site specific for TRAILR2 is TRv7 and the antigen binding site specific for CDH17 is CDH17E2 or CDH17H2.

Preferably the antigen binding site specific for TRAILR2 comprises a heavy chain variable domain comprising the amino acid sequence of SEQ ID NO.:108 and a light chain variable domain comprising the amino acid sequence of SEQ ID NO.:109 and the antigen binding site specific for CDH17 comprises a heavy chain variable domain comprising the amino acid sequence of SEQ ID NO.:114 and a light chain variable domain comprising the amino acid sequence of SEQ ID NO.:115. In this embodiment the antigen binding site specific for TRAILR2 is TRv7 (e.g., scFv of SEQ ID NO: 130) and the antigen binding site specific for CDH17 is CDH17E2.

Preferably the antigen binding site specific for TRAILR2 comprises a heavy chain variable domain comprising the amino acid sequence of SEQ ID NO.:108 and a light chain variable domain comprising the amino acid sequence of SEQ ID NO.:109 and the antigen binding site specific for CDH17 comprises a heavy chain variable domain comprising the amino acid sequence of SEQ ID NO.:116 and a light chain variable domain comprising the amino acid sequence of SEQ ID NO.:117. In this embodiment the antigen binding site specific for TRAILR2 is TRv7 (e.g., scFv of SEQ ID NO: 130) and the antigen binding site specific for CDH17 is CDH17H2.

In a preferred embodiment of the binding molecule of the invention, the antigen binding site specific for TRAILR2 comprises heavy chain CDRs comprising the amino acid sequences of SEQ ID NO.:43 (CDR1), SEQ ID NO.:47 (CDR2) and SEQ ID NO.:48 (CDR3) and light chain CDRs comprising the amino acid sequences of SEQ ID NO.:49 (CDR1), SEQ ID NO.53 (CDR2) and SEQ ID NO.:57 (CDR3) and the antigen binding site specific for CDH17 comprises heavy chain CDRs comprising the amino acid sequences of SEQ ID NO.:76 (CDR1), SEQ ID NO.:77 (CDR2) and SEQ ID NO.:78 (CDR3) and light chain CDRs comprising the amino acid sequences of SEQ ID NO.:79 (CDR1), SEQ ID NO.80 (CDR2) and SEQ ID NO.:81 (CDR3). In this embodiment the antigen binding site specific for TRAILR2 is TRv7 and the antigen binding site specific for CDH17 is CDH17v1.

Preferably the antigen binding site specific for TRAILR2 comprises a heavy chain variable domain comprising the amino acid sequence of SEQ ID NO.:108 and a light chain variable domain comprising the amino acid sequence of SEQ ID NO.:109 and the antigen binding site specific for CDH17 comprises a heavy chain variable domain comprising the amino acid sequence of SEQ ID NO.:118 and a light chain variable domain comprising the amino acid sequence of SEQ ID NO.:119. In this embodiment the antigen binding site specific for TRAILR2 is TRv7 (e.g., scFv of SEQ ID NO: 130) and the antigen binding site specific for CDH17 is CDH17v1.

Set out above are specific combinations of the antigen binding sites specific for TRAILR2 and CDH17 (e.g. TRAILR2 binding site of any one of TR #1, TR #2, TR #3, TR #7, TR #8, TR #10, TR #12, TR2v1, TR2v2, TR2v3, TR2v4, TR2v5, TR2v6, and TR2v7 combined with a CDH17 binding site of any one of CDH17E9, CDH17A6, CDH17E2, CDH17H2 and CDH17v1) that can be used in the binding molecule of the invention (e.g. bispecific and tetravalent binding molecules).

In some embodiments of the combinations described above, the antigen binding site for CDH17 comprises a heavy chain variable domain specific for CDH17 (e.g., VH of antigen binding site CDH17E9, CDH17A6, CDH17E2, CDH17H2 or CDH17v1) and is fused to a human heavy chain constant region, for example, constant region IgG, IgG1, IgG2, IgG3, IgG4, IgA, IgE or IgM. Preferably the heavy chain constant region of human IgG1 is used.

A further embodiment of the invention is wherein the antigen binding site for CDH17 further comprises a light chain variable domain specific for CDH17 (e.g., VL of antigen binding site CDH17E9, CDH17A6, CDH17E2, CDH17H2 or CDH17v1) and is fused to the human light chain constant region kappa or lambda. Preferably the light chain constant region of human kappa is used.

In some embodiments, the binding molecule comprises an Ig molecule (comprising two VH domains, each of them fused to heavy chain constant regions, e.g. constant IgG1 regions, and two VL domains, each of them fused to light chain constant regions) comprising any of the CDH17 specific antigen binding sites (CDH17E9, CDH17A6, CDH17E2, CDH17H2 or CDH17v1) and two scFvs comprising any of the TRAILR2 specific antigen binding sites (TR #1, TR #2, TR #3, TR #7, TR #8, TR #10, TR #12, TR2v1, TR2v2, TR2v3, TR2v4, TR2v5, TR2v6, or TR2v7), where each of the scFv(s) is fused to the C-terminus of the IgG molecule (e.g. one scFv to one heavy chain and the other scFv to the other heavy chain, each via a peptide linker), thereby forming a bispecifc tetravalent binding molecule.

Example sequences for heavy chain constant regions of human IgG1 wild type is provided in SEQ ID NO: 120, IgG1 KO is provided in SEQ ID NO: 121, IgG4 Pro wild type is provided in SEQ ID NO: 122. IgG1 FcRnmut is provided in SEQ ID NO: 270. Preferably the heavy chain constant region is IgG1KO as provided in SEQ ID:121 or IgG1FcRnmut as provided in SEQ ID NO: 270.

Example sequence for light chain constant region of human kappa provided in SEQ ID NO: 123.

Provided below are binding molecules (also referred to herein as multi-specific binding proteins) of the invention. Each of the specific molecules/proteins of the invention comprise modified immunoglobulin molecules in which (i) the immunoglobulin heavy chain comprises an amino acid sequence of a heavy chain variable domain which binds specifically to CDH17 (e.g., VH of any one of CDH17E9, CDH17A6, CDH17E2, CDH17H2 and CDH17v1), immunoglobulin heavy chain constant domains and also an scFv, which binds specifically to TRAILR2, comprising an amino acid sequence of light chain and heavy chain variable domains (e.g., VL and VH of any one of TR #1, TR #2, TR #3, TR #7, TR #8, TR #10, TR #12, TR2v1, TR2v2, TR2v3, TR2v4, TR2v5, TR2v6, and TR2v7), and which scFv is linked to the C-terminal end of the Ig constant domains, and (ii) the immunoglobulin light chain comprises an amino acid sequence of a light chain variable domain which binds specifically to CDH17 (e.g., VL any one of CDH17E9, CDH17A6, CDH17E2, CDH17H2 and CDH17v1) and a light chain constant domain. Preferably, the modified immunoglobulin molecules comprise two immunoglobulin heavy chains (e.g. modified heavy chains) and two immunoglobulin light chains.

In some embodiments, the binding molecules provided in the various aspects below, which are defined by their heavy chain amino acid sequence (e.g. a modified heavy chain with an scFv fused to the C-terminus of an Ig heavy chain) as well as their light chain amino acid sequences, comprise two heavy chains and two light chains, thereby forming a symmetric tetravalent and bispecific structure.

A further aspect of the invention provides a binding molecule comprising a heavy chain comprising the amino acid sequence of SEQ ID NO. 159 and a light chain comprising the amino acid sequence of SEQ ID NO. 173. In this aspect the antigen binding site specific for CDH17 is CDH17E9 and the antigen binding site specific for TRAILR2 is TR #1.

A further aspect of the invention provides a binding molecule comprising a heavy chain comprising the amino acid sequence of SEQ ID NO. 160 and a light chain comprising the amino acid sequence of SEQ ID NO. 173. In this aspect the antigen binding site specific for CDH17 is CDH17E9 and the antigen binding site specific for TRAILR2 is TR #2.

A further aspect of the invention provides a binding molecule comprising a heavy chain comprising the amino acid sequence of SEQ ID NO. 161 and a light chain comprising the amino acid sequence of SEQ ID NO. 173. In this aspect the antigen binding site specific for CDH17 is CDH17E9 and the antigen binding site specific for TRAILR2 is TR #3.

A further aspect of the invention provides a binding molecule comprising a heavy chain comprising the amino acid sequence of SEQ ID NO. 162 and a light chain comprising the amino acid sequence of SEQ ID NO. 173. In this aspect the antigen binding site specific for CDH17 is CDH17E9 and the antigen binding site specific for TRAILR2 is TR #7.

A further aspect of the invention provides a binding molecule comprising a heavy chain comprising the amino acid sequence of SEQ ID NO. 163 and a light chain comprising the amino acid sequence of SEQ ID NO. 173. In this aspect the antigen binding site specific for CDH17 is CDH17E9 and the antigen binding site specific for TRAILR2 is TR #8.

A further aspect of the invention provides a binding molecule comprising a heavy chain comprising the amino acid sequence of SEQ ID NO. 164 and a light chain comprising the amino acid sequence of SEQ ID NO. 173. In this aspect the antigen binding site specific for CDH17 is CDH17E9 and the antigen binding site specific for TRAILR2 is TR #10.

A further aspect of the invention provides a binding molecule comprising a heavy chain comprising the amino acid sequence of SEQ ID NO. 165 and a light chain comprising the amino acid sequence of SEQ ID NO. 173. In this aspect the antigen binding site specific for CDH17 is CDH17E9 and the antigen binding site specific for TRAILR2 is TR #12.

A further aspect of the invention provides a binding molecule comprising a heavy chain comprising the amino acid sequence of SEQ ID NO. 166 and a light chain comprising the amino acid sequence of SEQ ID NO. 173. In this aspect the antigen binding site specific for CDH17 is CDH17E9 and the antigen binding site specific for TRAILR2 is TRv1.

A further aspect of the invention provides a binding molecule comprising a heavy chain comprising the amino acid sequence of SEQ ID NO. 167 and a light chain comprising the amino acid sequence of SEQ ID NO. 173. In this aspect the antigen binding site specific for CDH17 is CDH17E9 and the antigen binding site specific for TRAILR2 is TRv2.

A further aspect of the invention provides a binding molecule comprising a heavy chain comprising the amino acid sequence of SEQ ID NO. 168 and a light chain comprising the amino acid sequence of SEQ ID NO. 173. In this aspect the antigen binding site specific for CDH17 is CDH17E9 and the antigen binding site specific for TRAILR2 is TRv3.

A further aspect of the invention provides a binding molecule comprising a heavy chain comprising the amino acid sequence of SEQ ID NO. 169 and a light chain comprising the amino acid sequence of SEQ ID NO. 173. In this aspect the antigen binding site specific for CDH17 is CDH17E9 and the antigen binding site specific for TRAILR2 is TRv4.

A further aspect of the invention provides a binding molecule comprising a heavy chain comprising the amino acid sequence of SEQ ID NO. 170 and a light chain comprising the amino acid sequence of SEQ ID NO. 173. In this aspect the antigen binding site specific for CDH17 is CDH17E9 and the antigen binding site specific for TRAILR2 is TRv5.

A further aspect of the invention provides a binding molecule comprising a heavy chain comprising the amino acid sequence of SEQ ID NO. 171 and a light chain comprising the amino acid sequence of SEQ ID NO. 173. In this aspect the antigen binding site specific for CDH17 is CDH17E9 and the antigen binding site specific for TRAILR2 is TRv6.

A further aspect of the invention provides a binding molecule comprising a heavy chain comprising the amino acid sequence of SEQ ID NO. 172 and a light chain comprising the amino acid sequence of SEQ ID NO. 173. In this aspect the antigen binding site specific for CDH17 is CDH17E9 and the antigen binding site specific for TRAILR2 is TRv7.

A further aspect of the invention provides a binding molecule comprising a heavy chain comprising the amino acid sequence of SEQ ID NO. 174 and a light chain comprising the amino acid sequence of SEQ ID NO. 188. In this aspect the antigen binding site specific for CDH17 is CDH17A6 and the antigen binding site specific for TRAILR2 is TR #1.

A further aspect of the invention provides a binding molecule comprising a heavy chain comprising the amino acid sequence of SEQ ID NO. 175 and a light chain comprising the amino acid sequence of SEQ ID NO. 188. In this aspect the antigen binding site specific for CDH17 is CDH17A6 and the antigen binding site specific for TRAILR2 is TR #2.

A further aspect of the invention provides a binding molecule comprising a heavy chain comprising the amino acid sequence of SEQ ID NO. 176 and a light chain comprising the amino acid sequence of SEQ ID NO. 188. In this aspect the antigen binding site specific for CDH17 is CDH17A6 and the antigen binding site specific for TRAILR2 is TR #3.

A further aspect of the invention provides a binding molecule comprising a heavy chain comprising the amino acid sequence of SEQ ID NO. 177 and a light chain comprising the amino acid sequence of SEQ ID NO. 188. In this aspect the antigen binding site specific for CDH17 is CDH17A6 and the antigen binding site specific for TRAILR2 is TR #7.

A further aspect of the invention provides a binding molecule comprising a heavy chain comprising the amino acid sequence of SEQ ID NO. 178 and a light chain comprising the amino acid sequence of SEQ ID NO. 188. In this aspect the antigen binding site specific for CDH17 is CDH17A6 and the antigen binding site specific for TRAILR2 is TR #8.

A further aspect of the invention provides a binding molecule comprising a heavy chain comprising the amino acid sequence of SEQ ID NO. 179 and a light chain comprising the amino acid sequence of SEQ ID NO. 188. In this aspect the antigen binding site specific for CDH17 is CDH17A6 and the antigen binding site specific for TRAILR2 is TR #10.

A further aspect of the invention provides a binding molecule comprising a heavy chain comprising the amino acid sequence of SEQ ID NO. 180 and a light chain comprising the amino acid sequence of SEQ ID NO. 188. In this aspect the antigen binding site specific for CDH17 is CDH17A6 and the antigen binding site specific for TRAILR2 is TR #12.

A further aspect of the invention provides a binding molecule comprising a heavy chain comprising the amino acid sequence of SEQ ID NO. 181 and a light chain comprising the amino acid sequence of SEQ ID NO. 188. In this aspect the antigen binding site specific for CDH17 is CDH17A6 and the antigen binding site specific for TRAILR2 is TRv1.

A further aspect of the invention provides a binding molecule comprising a heavy chain comprising the amino acid sequence of SEQ ID NO. 182 and a light chain comprising the amino acid sequence of SEQ ID NO. 188. In this aspect the antigen binding site specific for CDH17 is CDH17A6 and the antigen binding site specific for TRAILR2 is TRv2.

A further aspect of the invention provides a binding molecule comprising a heavy chain comprising the amino acid sequence of SEQ ID NO. 183 and a light chain comprising the amino acid sequence of SEQ ID NO. 188. In this aspect the antigen binding site specific for CDH17 is CDH17A6 and the antigen binding site specific for TRAILR2 is TRv3.

A further aspect of the invention provides a binding molecule comprising a heavy chain comprising the amino acid sequence of SEQ ID NO. 184 and a light chain comprising the amino acid sequence of SEQ ID NO. 188. In this aspect the antigen binding site specific for CDH17 is CDH17A6 and the antigen binding site specific for TRAILR2 is TRv4.

A further aspect of the invention provides a binding molecule comprising a heavy chain comprising the amino acid sequence of SEQ ID NO. 185 and a light chain comprising the amino acid sequence of SEQ ID NO. 188. In this aspect the antigen binding site specific for CDH17 is CDH17A6 and the antigen binding site specific for TRAILR2 is TRv5.

A further aspect of the invention provides a binding molecule comprising a heavy chain comprising the amino acid sequence of SEQ ID NO. 186 and a light chain comprising the amino acid sequence of SEQ ID NO. 188. In this aspect the antigen binding site specific for CDH17 is CDH17A6 and the antigen binding site specific for TRAILR2 is TRv6.

A further aspect of the invention provides a binding molecule comprising a heavy chain comprising the amino acid sequence of SEQ ID NO. 187 and a light chain comprising the amino acid sequence of SEQ ID NO. 188. In this aspect the antigen binding site specific for CDH17 is CDH17A6 and the antigen binding site specific for TRAILR2 is TRv7.

A further aspect of the invention provides a binding molecule comprising a heavy chain comprising the amino acid sequence of SEQ ID NO. 189 and a light chain comprising the amino acid sequence of SEQ ID NO. 203. In this aspect the antigen binding site specific for CDH17 is CDH17E2 and the antigen binding site specific for TRAILR2 is TR #1.

A further aspect of the invention provides a binding molecule comprising a heavy chain comprising the amino acid sequence of SEQ ID NO. 190 and a light chain comprising the amino acid sequence of SEQ ID NO. 203. In this aspect the antigen binding site specific for CDH17 is CDH17E2 and the antigen binding site specific for TRAILR2 is TR #2.

A further aspect of the invention provides a binding molecule comprising a heavy chain comprising the amino acid sequence of SEQ ID NO. 191 and a light chain comprising the amino acid sequence of SEQ ID NO. 203. In this aspect the antigen binding site specific for CDH17 is CDH17E2 and the antigen binding site specific for TRAILR2 is TR #3.

A further aspect of the invention provides a binding molecule comprising a heavy chain comprising the amino acid sequence of SEQ ID NO. 192 and a light chain comprising the amino acid sequence of SEQ ID NO. 203. In this aspect the antigen binding site specific for CDH17 is CDH17E2 and the antigen binding site specific for TRAILR2 is TR #7.

A further aspect of the invention provides a binding molecule comprising a heavy chain comprising the amino acid sequence of SEQ ID NO. 193 and a light chain comprising the amino acid sequence of SEQ ID NO. 203. In this aspect the antigen binding site specific for CDH17 is CDH17E2 and the antigen binding site specific for TRAILR2 is TR #8.

A further aspect of the invention provides a binding molecule comprising a heavy chain comprising the amino acid sequence of SEQ ID NO. 194 and a light chain comprising the amino acid sequence of SEQ ID NO. 203. In this aspect the antigen binding site specific for CDH17 is CDH17E2 and the antigen binding site specific for TRAILR2 is TR #10.

A further aspect of the invention provides a binding molecule comprising a heavy chain comprising the amino acid sequence of SEQ ID NO. 195 and a light chain comprising the amino acid sequence of SEQ ID NO. 203. In this aspect the antigen binding site specific for CDH17 is CDH17E2 and the antigen binding site specific for TRAILR2 is TR #12.

A further aspect of the invention provides a binding molecule comprising a heavy chain comprising the amino acid sequence of SEQ ID NO. 196 and a light chain comprising the amino acid sequence of SEQ ID NO. 203. In this aspect the antigen binding site specific for CDH17 is CDH17E2 and the antigen binding site specific for TRAILR2 is TRv1.

A further aspect of the invention provides a binding molecule comprising a heavy chain comprising the amino acid sequence of SEQ ID NO. 197 and a light chain comprising the amino acid sequence of SEQ ID NO. 203. In this aspect the antigen binding site specific for CDH17 is CDH17E2 and the antigen binding site specific for TRAILR2 is TRv2.

A further aspect of the invention provides a binding molecule comprising a heavy chain comprising the amino acid sequence of SEQ ID NO. 198 and a light chain comprising the amino acid sequence of SEQ ID NO. 203. In this aspect the antigen binding site specific for CDH17 is CDH17E2 and the antigen binding site specific for TRAILR2 is TRv3.

A further aspect of the invention provides a binding molecule comprising a heavy chain comprising the amino acid sequence of SEQ ID NO. 199 and a light chain comprising the amino acid sequence of SEQ ID NO. 203. In this aspect the antigen binding site specific for CDH17 is CDH17E2 and the antigen binding site specific for TRAILR2 is TRv4.

A further aspect of the invention provides a binding molecule comprising a heavy chain comprising the amino acid sequence of SEQ ID NO. 200 and a light chain comprising the amino acid sequence of SEQ ID NO. 203. In this aspect the antigen binding site specific for CDH17 is CDH17E2 and the antigen binding site specific for TRAILR2 is TRv5.

A further aspect of the invention provides a binding molecule comprising a heavy chain comprising the amino acid sequence of SEQ ID NO. 201 and a light chain comprising the amino acid sequence of SEQ ID NO. 203. In this aspect the antigen binding site specific for CDH17 is CDH17E2 and the antigen binding site specific for TRAILR2 is TRv6.

A further aspect of the invention provides a binding molecule comprising a heavy chain comprising the amino acid sequence of SEQ ID NO. 202 and a light chain comprising the amino acid sequence of SEQ ID NO. 203. In this aspect the antigen binding site specific for CDH17 is CDH17E2 and the antigen binding site specific for TRAILR2 is TRv7.

A further aspect of the invention provides a binding molecule comprising a heavy chain comprising the amino acid sequence of SEQ ID NO. 204 and a light chain comprising the amino acid sequence of SEQ ID NO. 218. In this aspect the antigen binding site specific for CDH17 is CDH17H2 and the antigen binding site specific for TRAILR2 is TR #1.

A further aspect of the invention provides a binding molecule comprising a heavy chain comprising the amino acid sequence of SEQ ID NO. 205 and a light chain comprising the amino acid sequence of SEQ ID NO. 218. In this aspect the antigen binding site specific for CDH17 is CDH17H2 and the antigen binding site specific for TRAILR2 is TR #2.

A further aspect of the invention provides a binding molecule comprising a heavy chain comprising the amino acid sequence of SEQ ID NO. 206 and a light chain comprising the amino acid sequence of SEQ ID NO. 218. In this aspect the antigen binding site specific for CDH17 is CDH17H2 and the antigen binding site specific for TRAILR2 is TR #3.

A further aspect of the invention provides a binding molecule comprising a heavy chain comprising the amino acid sequence of SEQ ID NO. 207 and a light chain comprising the amino acid sequence of SEQ ID NO. 218. In this aspect the antigen binding site specific for CDH17 is CDH17H2 and the antigen binding site specific for TRAILR2 is TR #7.

A further aspect of the invention provides a binding molecule comprising a heavy chain comprising the amino acid sequence of SEQ ID NO. 208 and a light chain comprising the amino acid sequence of SEQ ID NO. 218. In this aspect the antigen binding site specific for CDH17 is CDH17H2 and the antigen binding site specific for TRAILR2 is TR #8.

A further aspect of the invention provides a binding molecule comprising a heavy chain comprising the amino acid sequence of SEQ ID NO. 209 and a light chain comprising the amino acid sequence of SEQ ID NO. 218. In this aspect the antigen binding site specific for CDH17 is CDH17H2 and the antigen binding site specific for TRAILR2 is TR #10.

A further aspect of the invention provides a binding molecule comprising a heavy chain comprising the amino acid sequence of SEQ ID NO. 210 and a light chain comprising the amino acid sequence of SEQ ID NO. 218. In this aspect the antigen binding site specific for CDH17 is CDH17H2 and the antigen binding site specific for TRAILR2 is TR #12.

A further aspect of the invention provides a binding molecule comprising a heavy chain comprising the amino acid sequence of SEQ ID NO. 211 and a light chain comprising the amino acid sequence of SEQ ID NO. 218. In this aspect the antigen binding site specific for CDH17 is CDH17H2 and the antigen binding site specific for TRAILR2 is TRv1.

A further aspect of the invention provides a binding molecule comprising a heavy chain comprising the amino acid sequence of SEQ ID NO. 212 and a light chain comprising the amino acid sequence of SEQ ID NO. 218. In this aspect the antigen binding site specific for CDH17 is CDH17H2 and the antigen binding site specific for TRAILR2 is TRv2.

A further aspect of the invention provides a binding molecule comprising a heavy chain comprising the amino acid sequence of SEQ ID NO. 271 and a light chain comprising the amino acid sequence of SEQ ID NO. 218. In this aspect the antigen binding site specific for CDH17 is CDH17H2 and the antigen binding site specific for TRAILR2 is TRv2.

A further aspect of the invention provides a binding molecule comprising a heavy chain comprising the amino acid sequence of SEQ ID NO. 213 and a light chain comprising the amino acid sequence of SEQ ID NO. 218. In this aspect the antigen binding site specific for CDH17 is CDH17H2 and the antigen binding site specific for TRAILR2 is TRv3.

A further aspect of the invention provides a binding molecule comprising a heavy chain comprising the amino acid sequence of SEQ ID NO. 214 and a light chain comprising the amino acid sequence of SEQ ID NO. 218. In this aspect the antigen binding site specific for CDH17 is CDH17H2 and the antigen binding site specific for TRAILR2 is TRv4.

A further aspect of the invention provides a binding molecule comprising a heavy chain comprising the amino acid sequence of SEQ ID NO. 215 and a light chain comprising the amino acid sequence of SEQ ID NO. 218. In this aspect the antigen binding site specific for CDH17 is CDH17H2 and the antigen binding site specific for TRAILR2 is TRv5.

A further aspect of the invention provides a binding molecule comprising a heavy chain comprising the amino acid sequence of SEQ ID NO. 216 and a light chain comprising the amino acid sequence of SEQ ID NO. 218. In this aspect the antigen binding site specific for CDH17 is CDH17H2 and the antigen binding site specific for TRAILR2 is TRv6.

A further aspect of the invention provides a binding molecule comprising a heavy chain comprising the amino acid sequence of SEQ ID NO. 217 and a light chain comprising the amino acid sequence of SEQ ID NO. 218. In this aspect the antigen binding site specific for CDH17 is CDH17H2 and the antigen binding site specific for TRAILR2 is TRv7.

A further aspect of the invention provides a binding molecule comprising a heavy chain comprising the amino acid sequence of SEQ ID NO. 219 and a light chain comprising the amino acid sequence of SEQ ID NO. 233. In this aspect the antigen binding site specific for CDH17 is CDH17v1 and the antigen binding site specific for TRAILR2 is TR #1.

A further aspect of the invention provides a binding molecule comprising a heavy chain comprising the amino acid sequence of SEQ ID NO. 220 and a light chain comprising the amino acid sequence of SEQ ID NO. 233. In this aspect the antigen binding site specific for CDH17 is CDH17v1 and the antigen binding site specific for TRAILR2 is TR #2.

A further aspect of the invention provides a binding molecule comprising a heavy chain comprising the amino acid sequence of SEQ ID NO. 221 and a light chain comprising the amino acid sequence of SEQ ID NO. 233. In this aspect the antigen binding site specific for CDH17 is CDH17v1 and the antigen binding site specific for TRAILR2 is TR #3.

A further aspect of the invention provides a binding molecule comprising a heavy chain comprising the amino acid sequence of SEQ ID NO. 222 and a light chain comprising the amino acid sequence of SEQ ID NO. 233. In this aspect the antigen binding site specific for CDH17 is CDH17v1 and the antigen binding site specific for TRAILR2 is TR #7.

A further aspect of the invention provides a binding molecule comprising a heavy chain comprising the amino acid sequence of SEQ ID NO. 223 and a light chain comprising the amino acid sequence of SEQ ID NO. 233. In this aspect the antigen binding site specific for CDH17 is CDH17v1 and the antigen binding site specific for TRAILR2 is TR #8.

A further aspect of the invention provides a binding molecule comprising a heavy chain comprising the amino acid sequence of SEQ ID NO. 224 and a light chain comprising the amino acid sequence of SEQ ID NO. 233. In this aspect the antigen binding site specific for CDH17 is CDH17v1 and the antigen binding site specific for TRAILR2 is TR #10.

A further aspect of the invention provides a binding molecule comprising a heavy chain comprising the amino acid sequence of SEQ ID NO. 225 and a light chain comprising the amino acid sequence of SEQ ID NO. 233. In this aspect the antigen binding site specific for CDH17 is CDH17v1 and the antigen binding site specific for TRAILR2 is TR #12.

A further aspect of the invention provides a binding molecule comprising a heavy chain comprising the amino acid sequence of SEQ ID NO. 226 and a light chain comprising the amino acid sequence of SEQ ID NO. 233. In this aspect the antigen binding site specific for CDH17 is CDH17v1 and the antigen binding site specific for TRAILR2 is TRv1.

A further aspect of the invention provides a binding molecule comprising (i) a heavy chain comprising the amino acid sequence of SEQ ID NO: 145 and a light chain comprising the amino acid sequence of SEQ ID NO:146; (ii) a heavy chain comprising the amino acid sequence of SEQ ID NO: 147 and a light chain comprising the amino acid sequence of SEQ ID NO:148; (iii) a heavy chain comprising the amino acid sequence of SEQ ID NO:153 and a light chain comprising the amino acid sequence of SEQ ID NO:154; (iv) a heavy chain comprising the amino acid sequence of SEQ ID NO: 155 and a light chain comprising the amino acid sequence of SEQ ID NO:156; or (v) a heavy chain comprising the amino acid sequence of SEQ ID NO: 157 and a light chain comprising the amino acid sequence of SEQ ID NO:158. In this aspect the antigen binding site specific for CDH17 is CDH17v1 and the antigen binding site specific for TRAILR2 is TRv1.

A further aspect of the invention provides a binding molecule comprising a heavy chain comprising the amino acid sequence of SEQ ID NO. 227 and a light chain comprising the amino acid sequence of SEQ ID NO. 233. In this aspect the antigen binding site specific for CDH17 is CDH17v1 and the antigen binding site specific for TRAILR2 is TRv2.

A further aspect of the invention provides a binding molecule comprising (i) a heavy chain comprising the amino acid sequence of SEQ ID NO:149 and a light chain comprising the amino acid sequence of SEQ ID NO:150, or (ii) a heavy chain comprising the amino acid sequence of SEQ ID NO:151 and a light chain comprising the amino acid sequence of SEQ ID NO:152. In this aspect the antigen binding site specific for CDH17 is CDH17v1 and the antigen binding site specific for TRAILR2 is TRv2.

A further aspect of the invention provides a binding molecule comprising a heavy chain comprising the amino acid sequence of SEQ ID NO. 228 and a light chain comprising the amino acid sequence of SEQ ID NO. 233. In this aspect the antigen binding site specific for CDH17 is CDH17v1 and the antigen binding site specific for TRAILR2 is TRv3.

A further aspect of the invention provides a binding molecule comprising a heavy chain comprising the amino acid sequence of SEQ ID NO. 229 and a light chain comprising the amino acid sequence of SEQ ID NO. 233. In this aspect the antigen binding site specific for CDH17 is CDH17v1 and the antigen binding site specific for TRAILR2 is TRv4.

A further aspect of the invention provides a binding molecule comprising a heavy chain comprising the amino acid sequence of SEQ ID NO. 230 and a light chain comprising the amino acid sequence of SEQ ID NO. 233. In this aspect the antigen binding site specific for CDH17 is CDH17v1 and the antigen binding site specific for TRAILR2 is TRv5.

A further aspect of the invention provides a binding molecule comprising a heavy chain comprising the amino acid sequence of SEQ ID NO. 231 and a light chain comprising the amino acid sequence of SEQ ID NO. 233. In this aspect the antigen binding site specific for CDH17 is CDH17v1 and the antigen binding site specific for TRAILR2 is TRv6.

A further aspect of the invention provides a binding molecule comprising a heavy chain comprising the amino acid sequence of SEQ ID NO. 232 and a light chain comprising the amino acid sequence of SEQ ID NO. 233. In this aspect the antigen binding site specific for CDH17 is CDH17v1 and the antigen binding site specific for TRAILR2 is TRv7.

Further provided herein are antibody molecules (e.g., a full length antibody/immunoglobulin molecule having a Y shaped structure with two heavy and two light chains, or fragments thereof such as Fv, Fab, Fab', or F(ab')2 fragment, a single chain antibody, single chain variable fragment (scFv)) that bind specifically to CDH17. In some embodiments, the antibody molecules specific for CDH17 are recombinant monoclonal antibodies, chimeric, humanized or human antibody molecules.

In some embodiments the antibody molecule specific for CDH17 comprises heavy chain CDRs comprising the amino acid sequences of SEQ ID NO.:58 (CDR1), SEQ ID NO.:59 (CDR2) and SEQ ID NO.:60 (CDR3) and light chain CDRs comprising the amino acid sequences of SEQ ID NO.:61 (CDR1), SEQ ID NO.62 (CDR2) and SEQ ID NO.:63 (CDR3).

In some embodiments the antibody molecule specific for CDH17 comprises a heavy chain variable domain comprising the amino acid sequence of SEQ ID NO.:110 and a light chain variable domain comprising the amino acid sequence of SEQ ID NO.:111.

In some embodiments the antibody molecule specific for CDH17 comprises heavy chain CDRs comprising the amino acid sequences of SEQ ID NO.:64 (CDR1), SEQ ID NO.:65 (CDR2) and SEQ ID NO.:66 (CDR3) and light chain CDRs comprising the amino acid sequences of SEQ ID NO.:67 (CDR1), SEQ ID NO.68 (CDR2) and SEQ ID NO.:69 (CDR3).

In some embodiments the antibody molecule specific for CDH17 comprises a heavy chain variable domain comprising the amino acid sequence of SEQ ID NO.:112 and a light chain variable domain comprising the amino acid sequence of SEQ ID NO.:113.

In some embodiments the antibody molecule specific for CDH17 comprises heavy chain CDRs comprising the amino acid sequences of SEQ ID NO.:70 (CDR1), SEQ ID NO.:71 (CDR2) and SEQ ID NO.:72 (CDR3) and light chain CDRs comprising the amino acid sequences of SEQ ID NO.:73 (CDR1), SEQ ID NO.74 (CDR2) and SEQ ID NO.:75 (CDR3).

In some embodiments the antibody molecule specific for CDH17 comprises a heavy chain variable domain comprising the amino acid sequence of SEQ ID NO.:114 and a light chain variable domain comprising the amino acid sequence of SEQ ID NO.:115.

In some embodiments the antibody molecule specific for CDH17 comprises a heavy chain variable domain comprising the amino acid sequence of SEQ ID NO.:116 and a light chain variable domain comprising the amino acid sequence of SEQ ID NO.:117.

In some embodiments the antibody molecule specific for CDH17 comprises heavy chain CDRs comprising the amino acid sequences of SEQ ID NO.:76 (CDR1), SEQ ID NO.:77 (CDR2) and SEQ ID NO.:78 (CDR3) and light chain CDRs comprising the amino acid sequences of SEQ ID NO.:79 (CDR1), SEQ ID NO.80 (CDR2) and SEQ ID NO.:81 (CDR3).

In some embodiments the antibody molecule specific for CDH17 comprises a heavy chain variable domain comprising the amino acid sequence of SEQ ID NO.:118 and a light chain variable domain comprising the amino acid sequence of SEQ ID NO.:119.

In some embodiments, the CDH17 specific antibodies as defined above further comprise human heavy chain constant domains (e.g., an IgG constant domain) and a human light chain constant domain (e.g. a kappa or lambda light chain constant domain). In some embodiments, the heavy chain constant domain is human IgG1 wildtype (e.g., as provided in SEQ ID NO: 120), IgG1 KO (e.g. as provided in SEQ ID NO: 121), IgG4 Pro wild type (e.g. as provided in SEQ ID NO: 122), or IgG1 FcRnmut (e.g. as provided in SEQ ID NO: 270). In some embodiments, the human light chain constant domain is human kappa (e.g., as provided in SEQ ID NO:123).

In some embodiments the CDH17 specific antibody has a heavy chain comprising the sequence of any one of SEQ ID NOs: 110, 112, 114, 116 or 118 fused to the sequence of any one of SEQ ID NOs; 120, 121, 122 or 270 and a light chain comprising the sequence of any one of SEQ ID NOs: 111, 113, 115, 117 or 119 fused to the sequence of SEQ ID NO:123 (e.g. a light chain comprising the sequence of any one of SEQ ID NOs: 173, 188, 203, 218 or 233).

The CDH17 specific antibodies provided herein may be used for labelling, localizing, identifying or targeting cells expressing CDH17 (e.g. in ELISA assays, FACS analysis, immunohistology or the like) by attaching a dye, a drug or another molecule with binding specificity for a different antigen. The CDH17 specific antibodies described herein alone do not have an effect on cell viability of cells expressing CDH17. In some embodiments, CDH17 specific antibodies specifically bind to the surface of a CDH17 expressing cell and are used for localizing and/or identifying such cells. In some embodiments, the CDH17 antibodies provided herein are used for identifying cells expressing CDH17 (e.g. tumor cells). In some embodiments, the CDH17 antibodies provided herein are used for delivering a drug or cytotoxic agent to a target cell (e.g. a tumor cell expressing CDH17) by attaching such drug or cytotoxic agent to said CDH17 antibody, thereby, for example, killing said target cell.

A further aspect of the invention provides isolated nucleic acid molecules that encode the binding molecule of the invention or the antibody molecule of the invention, or an expression vector comprising such a nucleic acid molecule(s).

In some embodiments the binding molecules of the invention or antibody molecule of the invention comprise antibody heavy chain and/or light chain polypeptides. As can be appreciated by the skilled person, nucleic acid molecules can be readily prepared which encode the heavy chain polypeptides, light chain polypeptides, or heavy chain polypeptides and light chain polypeptides.

Nucleic acid molecules coding for the light chain and the heavy chain may be synthesized chemically and enzymatically by Polymerase Chain Reaction (PCR) using standard methods. First, suitable oligonucleotides can be synthesized with methods known in the art (e.g. Gait, 1984), which can be used to produce a synthetic gene. Methods to generate synthetic genes from oligonucleotides are known in the art (e.g. Stemmer et al., 1995; Ye et al., 1992; Hayden et Mandecki, 1988; Frank et al., 1987).

The nucleic acid molecules of the invention include, but are not limited to, the DNA molecules encoding the polypeptide sequences shown in the sequence listing. Also, the present invention also relates to nucleic acid molecules that hybridize to the DNA molecules encoding the polypeptide sequences shown in the sequence listing under high stringency binding and washing conditions, as defined in WO 2007/042309. Preferred molecules (from an mRNA perspective) are those that have at least 75% or 80% (preferably at least 85%, more preferably at least 90% and most preferably at least 95%) homology or sequence identity with one of the DNA molecules described herein. By way of example, in view of expressing the antibodies in eukaryotic cells, the DNA sequences shown in the sequence listing have been designed to match codon usage in eukaryotic cells. If it is desired to express the antibodies in E. coli, these sequences can be changed to match *E. coli* codon usage. Variants of DNA molecules of the invention can be constructed in several different ways, as described e.g. in WO 2007/042309.

As used herein, the terms "identical" or "percent identity," in the context of two or more nucleic acids or polypeptide sequences, refer to two or more sequences or subsequences that are the same or have a specified percentage of nucleotides or amino acid residues that are the same, when compared and aligned for maximum correspondence. To determine the percent identity, the sequences are aligned for optimal comparison purposes (e.g., gaps can be introduced in the sequence of a first amino acid or nucleic acid sequence for optimal alignment with a second amino or nucleic acid sequence). The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position. The percent identity between the two sequences is a function of the number of identical positions shared by the sequences (i.e., % identity=# of identical positions/total # of positions (e.g., overlapping positions)×100). In some embodiments, the two sequences that are compared are the same length after gaps are introduced within the sequences, as appropriate (e.g., excluding additional sequence extending beyond the sequences being compared). For example, when variable region sequences are compared, the leader and/or constant domain sequences are not considered. For sequence comparisons between two sequences, a "corresponding" CDR refers to a CDR in the same location in both sequences (e.g., CDR-H1 of each sequence).

The determination of percent identity or percent similarity between two sequences can be accomplished using a mathematical algorithm. A preferred, non-limiting example of a mathematical algorithm utilized for the comparison of two sequences is the algorithm of Karlin and Altschul, 1990, Proc. Natl. Acad. Sci. USA 87:2264-2268, modified as in Karlin and Altschul, 1993, Proc. Natl. Acad. Sci. USA 90:5873-5877. Such an algorithm is incorporated into the NBLAST and XBLAST programs of Altschul et al., 1990, J. Mol. Biol. 215:403-410. BLAST nucleotide searches can be performed with the NBLAST program, score=100, wordlength=12, to obtain nucleotide sequences homologous to a nucleic acid encoding a protein of interest. BLAST protein searches can be performed with the XBLAST program, score=50, wordlength=3, to obtain amino acid sequences homologous to a protein of interest. To obtain gapped alignments for comparison purposes, Gapped BLAST can be utilized as described in Altschul et al., 1997, Nucleic Acids Res. 25:3389-3402. Alternatively, PSI-Blast can be used to perform an iterated search which detects distant relationships between molecules (Id.). When utilizing BLAST, Gapped BLAST, and PSI-Blast programs, the default parameters of the respective programs (e.g., XBLAST and NBLAST) can be used. Another preferred, non-limiting example of a mathematical algorithm utilized for the comparison of sequences is the algorithm of Myers and Miller, CABIOS (1989). Such an algorithm is incorporated into the ALIGN program (version 2.0) which is part of the GCG sequence alignment software package. When utilizing the ALIGN program for comparing amino acid sequences, a PAM120 weight residue table, a gap length penalty of 12, and a gap penalty of 4 can be used. Additional algorithms for sequence analysis are known in the art and include ADVANCE and ADAM as described in Torellis and Robotti, 1994, Comput. Appl. Biosci. 10:3-5; and FASTA described in Pearson and Lipman, 1988, Proc. Natl. Acad. Sci. USA 85:2444-8. Within FASTA, ktup is a control option that sets the sensitivity and speed of the search. If ktup=2, similar regions in the two sequences being compared are found by looking at pairs of aligned residues; if ktup=1, single aligned amino acids are examined ktup can be set to 2 or 1 for protein sequences, or from 1 to 6 for DNA sequences. The default if ktup is not specified is 2 for proteins and 6 for DNA. Alternatively, protein sequence alignment may be carried out using the CLUSTAL W algorithm, as described by Higgins et al., 1996, Methods Enzymol. 266:383-402.

A further aspect of the invention provides a method of production of a binding or antibody molecule described herein, comprising:

(a) cultivating the host cell of the invention under conditions allowing expression of the molecule; and, (b) recovering the molecule; and optionally c) further purifying and/or modifying and/or formulating the molecule.

An embodiment of this aspect of the invention is wherein the method of production further comprises step (c) further purifying and/or modifying and/or formulating the binding molecule of the invention.

For producing the binding molecules or antibodies of the invention, the DNA molecules encoding full-length light and/or heavy chains or fragments thereof are inserted into an expression vector such that the sequences are operatively linked to transcriptional and translational control sequences.

For manufacturing the binding molecules or antibodies of the invention, the skilled artisan may choose from a great variety of expression systems well known in the art, e.g. those reviewed by Kipriyanov and Le Gall, Curr Opin Drug Discov Devel. 2004 March; 7(2):233-42.

Expression vectors include plasmids, retroviruses, cosmids, EBV-derived episomes, and the like. The expression vector and expression control sequences are selected to be compatible with the host cell. The antibody light chain gene and the antibody heavy chain gene or the gene of the heavy chain of the binding molecule described herein (e.g. the gene comprising an immunoglobulin heavy chain sequence attached with its C-terminus to a scFv sequence) can be inserted into separate vectors. In certain embodiments, both DNA sequences, light and heavy chain sequences, are inserted into the same expression vector. Convenient vectors are those that encode a functionally complete human CH or CL immunoglobulin sequence, with appropriate restriction sites engineered so that any VH or VL sequence can be easily inserted and expressed, as described above. The constant chain is usually kappa or lambda for the antibody light chain, for the antibody heavy chain, it can be, without limitation, any IgG isotype (IgG1, IgG2, IgG3, IgG4) or other immunoglobulins, including allelic variants.

The recombinant expression vector may also encode a signal peptide that facilitates secretion of the antibody chain (e.g., the heavy and light chains of the binding molecules or antibodies described herein) from a host cell. The DNA encoding the antibody chain may be cloned into the vector such that the signal peptide is linked in-frame to the amino terminus of the mature antibody chain DNA. The signal peptide may be an immunoglobulin signal peptide or a heterologous peptide from a non-immunoglobulin protein. Alternatively, the DNA sequence encoding the antibody chain (e.g., the heavy and light chains of the binding molecules or antibodies described herein) may already contain a signal peptide sequence.

In addition to the DNA sequences encoding the antibody chains (e.g., the heavy and light chains of the binding molecules or antibodies described herein), the recombinant expression vectors carry regulatory sequences including promoters, enhancers, termination and polyadenylation signals and other expression control elements that control the expression of the antibody chains in a host cell. Examples for promoter sequences (exemplified for expression in mammalian cells) are promoters and/or enhancers derived from (CMV) (such as the CMV Simian Virus 40 (SV40) (such as the SV40 promoter/enhancer), adenovirus, (e. g., the adenovirus major late promoter (AdMLP)), polyoma and strong mammalian promoters such as native immunoglobulin and actin promoters. Examples for polyadenylation signals are BGH polyA, SV40 late or early polyA; alternatively, 3'UTRs of immunoglobulin genes etc. can be used.

The recombinant expression vectors may also carry sequences that regulate replication of the vector in host cells (e. g. origins of replication) and selectable marker genes. Nucleic acid molecules encoding the heavy chain or an antigen-binding portion thereof and/or the light chain or an antigen-binding portion thereof of a binding molecule or antibody described herein, and vectors comprising these DNA molecules can be introduced into host cells, e.g. bacterial cells or higher eukaryotic cells, e.g. mammalian cells, according to transfection methods well known in the art, including liposome-mediated transfection, polycation-mediated transfection, protoplast fusion, microinjections, calcium phosphate precipitation, electroporation or transfer by viral vectors.

Preferably, the nucleic acid molecules encoding the heavy chain and the light chain of the binding molecules or antibodies described herein are present on two vectors which are co-transfected into the host cell, preferably a mammalian cell.

Hence a further aspect provides a host cell comprising an expression vector comprising a nucleic acid molecule encoding the heavy chain and an expression vector comprising a nucleic acid molecule encoding the light chain of the binding molecules or antibodies described herein.

Mammalian cell lines available as hosts for expression are well known in the art and include, inter alia, Chinese hamster ovary (CHO, CHO-DG44) cells, NSO, SP2/0 cells, HeLa cells, baby hamster kidney (BHK) cells, monkey kidney cells (COS), human carcinoma cells (e. g., Hep G2), A549 cells, 3T3 cells or the derivatives/progenies of any such cell line. Other mammalian cells, including but not limited to human, mice, rat, monkey and rodent cells lines, or other eukaryotic cells, including but not limited to yeast, insect and plant cells, or prokaryotic cells such as bacteria may be used. The binding molecules of the invention are produced by culturing the host cells for a period of time sufficient to allow for expression of the binding molecule in the host cells.

Binding molecules and antibody molecules as described herein are preferably recovered from the culture medium as a secreted polypeptide or it can be recovered from host cell lysates if for example expressed without a secretory signal. It is necessary to purify the binding molecules or antibody molecules described herein using standard protein purification methods used for recombinant proteins and host cell proteins in a way that substantially homogenous preparations of the binding molecule or antibody as described herein are obtained. By way of example, state-of-the art purification methods useful for obtaining the binding molecules and antibodies of the invention include, as a first step, removal of cells and/or particulate cell debris from the culture medium or lysate. The binding molecule or antibody is then purified from contaminant soluble proteins, polypeptides and nucleic acids, for example, by fractionation on immunoaffinity or ion-exchange columns, ethanol precipitation, reverse phase HPLC, Sephadex chromatography, chromatography on silica or on a cation exchange resin. As a final step in the process for obtaining a TRAILR2 and CDH17 binding molecule or CDH17 antibody as described herein, the purified binding molecule or antibody may be dried, e.g. lyophilized, as described below for therapeutic applications.

A further aspect of the invention provides the binding molecule or the antibody of the invention for use in medicine.

A further aspect of the invention provides the binding molecule of the invention (binding molecules with a TRAILR2 binding site of any one of TR #1, TR #2, TR #3, TR #7, TR #8, TR #10, TR #12, TR2v1, TR2v2, TR2v3, TR2v4, TR2v5, TR2v6, and TR2v7 and a CDH17 binding site of any one of CDH17E9, CDH17A6, CDH17E2, CDH17H2 and CDH17v1) or the antibody specific for CDH17 (e.g. fused to a cytotoxic drug) for use in the therapy of cancer. It is preferred that the cancer is colorectal cancer (CRC), gastric cancer (GC), pancreatic cancer (PAC), liver cancer (including biliary tree cancer) or neuroendocrine tumors.

A stated above the inventors have identified that the binding molecules described herein have much utility for inducing apoptosis in cancer cells and therefore can be used in the therapy of cancers which express both TRAILR2 and CDH17. Methods of identifying whether a particular tumor expresses TRAILR2 and CDH17 are well known in the art. For example immunohistochemistry can be used to determine whether tumor tissue expresses TRAILR2 and CDH17 (e.g. using the CDH17 antibodies as described herein) and hence would be suitable for treatment with the binding molecule of the invention.

In particular, the binding molecule of the invention has utility in the treatment of colorectal cancer (CRC).

CRC is a distinct malignant disease listed in ICD-10 and one of the leading causes of cancer morbidity and mortality worldwide. Approximately 25% of CRC patients present with overt metastasis and metastatic disease develops in 40-50% of newly diagnosed patients. Although recent improvements in chemotherapy have extended survival durations of metastatic CRC, most patients will succumb to their disease. Hence there is a great need for further therapeutic agents to treat this disease.

Approximately 30-50% of colorectal cancers are known to have a mutated (abnormal) KRAS gene. KRAS mutations frequently found in neoplasms include those at exon 2 (codons 12 and 13) and exon 3 (codon 61) and can be analyzed from tumor biopsies. They include activating mutations that result in continual signal transduction, stimulating downstream signaling pathways involved in cell growth, proliferation, invasion, and metastasis. It has been suggested that oncogenic K-Ras can provide resistance to apoptosis induced by TRAIL (Hoogwater et al., Gastroenterology. 2010 June; 138(7):2357-67). In some embodiments, the binding molecules described herein (binding molecules with a TRAILR2 binding site of any one of TR #1, TR #2, TR #3, TR #7, TR #8, TR #10, TR #12, TR2v1, TR2v2, TR2v3, TR2v4, TR2v5, TR2v6, and TR2v7 and a CDH17 binding site of any one of CDH17E9, CDH17A6, CDH17E2, CDH17H2 and CDH17v1) are for use in the treatment of a KRAS wild type colorectal cancer (i.e., patients with KRAS wildtype tumors). In some embodiments, the binding molecules described herein (binding molecules with a TRAILR2 binding site of any one of TR #1, TR #2, TR #3, TR #7, TR #8, TR #10, TR #12, TR2v1, TR2v2, TR2v3, TR2v4, TR2v5, TR2v6, and TR2v7 and a CDH17 binding site of any one of CDH17E9, CDH17A6, CDH17E2, CDH17H2 and CDH17v1) are for use in the treatment of a KRAS mutant colorectal cancer (i.e., patients with KRAS mutant tumors).

In a further aspect the present invention relates to methods for the treatment or prevention of cancer, which method comprises the administration of an effective amount of the binding molecule of the invention to a human being (e.g. an individual suffering from cancer or being at risk of developing cancer).

The preferred mode of application is parenteral, by infusion or injection (intraveneous, intramuscular, subcutaneous, intraperitoneal, intradermal), but other modes of application such as by inhalation, transdermal, intranasal, buccal, oral, may also be applicable.

In a further aspect, a binding molecule of the invention is used in combination with a device useful for the administration of the binding molecule, such as a syringe, injector pen, micropump, or other device. In a further aspect, a binding molecule of the invention is comprised in a kit of parts, for example also including a package insert with instructions for the use of the binding molecule.

The "therapeutically effective amount" of the molecule to be administered is the minimum amount necessary to prevent, ameliorate, or treat clinical symptoms of cancer, in particular the minimum amount which is effective to these disorders.

The dose range of the binding molecule of the invention applicable per day is usually from 1 µg/kg to 100 mg/kg, preferably from 0.1 mg/kg to 20 mg/kg.

Generally, for the treatment and/or alleviation of the diseases, disorders and conditions mentioned herein and depending on the specific disease, disorder or condition to be treated, the potency of the specific binding molecule of the invention to be used, the specific route of administration and the specific pharmaceutical formulation or composition used, the antibody molecules of the invention will generally be administered in an amount between 0.005 and 20.0 mg per kilogram of body weight and dose, preferably between 0.05 and 10.0 mg/kg/dose, and more preferably between 0.5 and 10 mg/kg/dose, either continuously (e.g. by infusion) or more preferably as single doses. The administration interval may be, for example, twice a week, weekly, or monthly doses, but can significantly vary, especially, depending on the before-mentioned parameters. Thus, in some cases it may be sufficient to use less than the minimum dose given above, whereas in other cases the upper limit may have to be exceeded.

When administering large amounts it may be advisable to divide them up into a number of smaller doses spread over the day.

Depending on the specific binding molecule of the invention and its specific pharmacokinetic and other properties, it may be administered daily, every second, third, fourth, fifth or sixth day, weekly, monthly, and the like. An administration regimen could include long-term, weekly treatment. By "long-term" is meant at least two weeks and preferably months, or years of duration.

The efficacy of the binding molecules of the invention, and of compositions comprising the same, can be tested using any suitable in vitro assay, cell-based assay, in vivo assay and/or animal model known per se, or any combination thereof, depending on the specific disease involved. Suitable assays and animal models will be clear to the skilled person, and for example include the assays and animal models used in the Examples below.

The actual pharmaceutically effective amount or therapeutic dosage will of course depend on factors known by those skilled in the art such as age and weight of the patient, route of administration and severity of disease. In any case the binding molecule of the invention will be administered at dosages and in a manner which allows a pharmaceutically effective amount to be delivered based upon patient's unique condition The binding molecules of the invention may be used on their own or in combination with other pharmacologically active ingredients, such as state-of-the-art or standard-of-care compounds, such as e.g. cytostatic or cytotoxic substances, cell proliferation inhibitors, anti-angiogenic substances, steroids, immune modulators/checkpoint inhibitors, and the like.

Hence a further aspect of the invention provides a pharmaceutical composition comprising a binding molecule of the invention, together with a pharmaceutically acceptable carrier and optionally one or more further active ingredients.

A further aspect of the invention provides a binding molecule of the invention for use in the therapy of cancer (e.g. an individual suffering from cancer or being at risk of developing cancer) wherein said therapy comprises one or more pharmacologically active substances, A further aspect of the invention provides the use of one or more active ingredients in the manufacture of a medicament for the therapy of cancer and/or tumors (e.g. an individual suffering from cancer or being at risk of developing cancer) wherein said medicament comprises the binding molecule of the invention.

Cytostatic and/or cytotoxic active substances which may be administered in combination with binding molecules of the invention include, without being restricted thereto, hormones, hormone analogues and antihormones, aromatase inhibitors, LHRH agonists and antagonists, inhibitors of growth factors (growth factors such as for example platelet derived growth factor (PDGF), fibroblast growth factor (FGF), vascular endothelial growth factor (VEGF), epidermal growth factor (EGF), insuline-like growth factors (IGF), human epidermal growth factor (HER, e.g. HER2, HER3, HER4) and hepatocyte growth factor (HGF)), inhibitors are for example (anti-)growth factor antibodies, (anti-)growth factor receptor antibodies and tyrosine kinase inhibitors, such as for example cetuximab, gefitinib, afatinib, nintedanib, imatinib, lapatinib, bosutinib and trastuzumab; antimetabolites (e.g. antifolates such as methotrexate, raltitrexed, pyrimidine analogues such as 5-fluorouracil (5-FU), gemcitabine, irinotecan, doxorubicin, TAS-102, capecitabine and gemcitabine, purine and adenosine analogues such as mercaptopurine, thioguanine, cladribine and pentostatin, cytarabine (ara C), fludarabine); antitumor antibiotics (e.g. anthracyclins); platinum derivatives (e.g. cisplatin, oxaliplatin, carboplatin); alkylation agents (e.g. estramustin, meclorethamine, melphalan, chlorambucil, busulphan, dacarbazin, cyclophosphamide, ifosfamide, temozolomide, nitrosoureas such as for example carmustin and lomustin, thiotepa); antimitotic agents (e.g. Vinca alkaloids such as for example vinblastine, vindesin, vinorelbin and vincristine; and taxanes such as paclitaxel, docetaxel); angiogenesis inhibitors, including bevacizumab, ramucirumab and aflibercept, tubuline inhibitors; DNA synthesis inhibitors, PARP inhibitors, topoisomerase inhibitors (e.g. epipodophyllotoxins such as for example etoposide and etopophos, teniposide, amsacrin, topotecan, irinotecan, mitoxantrone), serine/threonine kinase inhibitors (e.g. PDK1 inhibitors, Raf inhibitors, A-Raf inhibitors, B-Raf inhibitors, C-Raf inhibitors, mTOR inhibitors, mTORC1/2 inhibitors, PI3K inhibitors, PI3Kα inhibitors, dual mTOR/PI3K inhibitors, STK33 inhibitors, AKT inhibitors, PLK1 inhibitors (such as volasertib), inhibitors of CDKs, including CDK9 inhibitors, Aurora kinase inhibitors), tyrosine kinase inhibitors (e.g. PTK2/FAK inhibitors), protein protein interaction inhibitors, MEK inhibitors, ERK inhibitors, FLT3 inhibitors, BRD4 inhibitors, IGF-1R inhibitors, Bcl-xL inhibitors, Bcl-2 inhibitors, Bcl-2/Bcl-xL inhibitors, ErbB receptor inhibitors, BCR-ABL inhibitors, ABL inhibitors, Src inhibitors, rapamycin analogs (e.g. everolimus, temsirolimus, ridaforolimus, sirolimus), androgen synthesis inhibitors, androgen receptor inhibitors, DNMT inhibitors, HDAC inhibitors, ANG1/2 inhibitors, CYP17 inhibitors, radiopharmaceuticals, immunotherapeutic agents such as immune checkpoint inhibitors (e.g. CTLA4, PD1, PD-L1, LAG3, and TIM3 binding molecules/immunoglobulins, such as ipilimumab, nivolumab, pembrolizumab) and various chemotherapeutic agents such as amifostin, anagrelid, clodronat, filgrastin, interferon, interferon alpha, leucovorin, rituximab, procarbazine, levamisole, mesna, mitotane, pamidronate and porfimer; proteasome inhibitors (such as Bortezomib); Smac and BH3 mimetics; agents restoring p53 functionality including mdm2-p53 antagonist; inhibitors of the Wnt/beta-catenin signaling pathway; and/or cyclin-dependent kinase 9 inhibitors.

Particularly preferred are treatments with the binding molecules of the invention in combination with a drug selected from below:
(i) anti-VEGF antibodies (bevacizumab and other anti-angiogenic substances) with or without chemotherapy combination (including doxorubicin/cyclophosphamide combination and/or capecitabine/docetaxel combination in neoadjuvant setting; taxane/platinum regimen for first and later line treatment) in breast cancer patients;
(ii) chemotherapeutics used for the treatment of CRC (including 5-fluorouracil, irinotecan, doxorubicin and TAS-102);
(iii) anti-EGFR antibodies (cetuximab and panitumumab in KRAS wild-type tumors) with or without chemotherapy combination (including irinotecan), anti-VEGF antibody combination (bevacizumab and other anti-angiogenic substances) or regorafenib combination, e.g. for the treatment of CRC patients.
(iv) immunotherapeutic agents, including anti-PD-1 and anti-PD-L1 agents and anti LAG3 agents, such as pembrolizumab and nivolumab and antibodies as disclosed in WO2017/198741, e.g. for treatment of CRC patients.

To be used in therapy, the binding molecule or antibody of the invention is formulated into pharmaceutical compositions appropriate to facilitate administration to animals or humans. Typical formulations of the binding molecule or antibody molecule described herein can be prepared by mixing the binding molecule or antibody molecule with physiologically acceptable carriers, excipients or stabilizers, in the form of lyophilized or otherwise dried formulations or aqueous solutions or aqueous or non-aqueous suspensions. Carriers, excipients, modifiers or stabilizers are nontoxic at the dosages and concentrations employed. They include buffer systems such as phosphate, citrate, acetate and other inorganic or organic acids and their salts; antioxidants including ascorbic acid and methionine; preservatives such as octadecyldimethylbenzyl ammonium chloride; hexamethonium chloride; benzalkonium chloride; benzethonium chloride; phenol, butyl or benzyl alcohol; alkyl parabens such as methyl or propyl paraben; catechol; resorcinol; cyclohexanol; 3-pentanol; and m-cresol; proteins, such as serum albumin, gelatin, or immunoglobulins; hydrophilic polymers such as polyvinylpyrrolidone or polyethylene glycol (PEG); amino acids such as glycine, glutamine, asparagine, histidine, arginine, or lysine; monosaccharides, disaccharides, oligosaccharides or polysaccharides and other carbohydrates including glucose, mannose, sucrose, trehalose, dextrins or dextrans; chelating agents such as EDTA; sugar alcohols such as, mannitol or sorbitol; salt-forming counter-ions such as sodium; metal complexes (e.g., Zn-protein complexes); and/or ionic or non-ionic surfactants such as TWEEN™ (polysorbates), PLURONICS™ or fatty acid esters, fatty acid ethers or sugar esters. Also organic solvents can be contained in the antibody formulation such as ethanol or isopropanol. The excipients may also have a release-modifying or absorption-modifying function.

Usually, aqueous solutions or suspensions will be preferred. Generally, suitable formulations for therapeutic proteins such as the binding molecules of the invention are buffered protein solutions, such as solutions including the protein in a suitable concentration (such as from 0.001 to 400 mg/ml, preferably from 0.005 to 200 mg/ml, more preferably 0.01 to 200 mg/ml, more preferably 1.0-100 mg/ml, such as 1.0 to 10.0 mg/ml (i.v. administration) or 100 mg/ml (s.c. administration) and an aqueous buffer such as:
phosphate buffered saline, pH 7.4,
other phosphate buffers, pH 6.2 to 8.2,
acetate buffers, pH 3.2 to 7.5, preferably pH 4.8 to 5.5
histidine buffers, pH 5.5 to 7.0,
succinate buffers, pH 3.2 to 6.6, and
citrate buffers, pH 2.1 to 6.2,
and, optionally, salts (e.g. NaCl) and/or stabilizing agents (such as e.g. sucrose, trehalose, lysine) and/or other polyalcohols (such as e g mannitol and glycerol) for providing isotonicity of the solution, and optionally detergents, e.g. to prevent aggregation (e.g. 0.02% Tween-20 or Tween-80).

Preferred buffered protein solutions for i.v. administration are solutions including about 10 mg/ml of the binding molecule of the invention dissolved in 10 mM citrate buffer, pH 5.5, 207 mM sucrose, 25 mM lysine HCl and 0.02% polysorbate 20. Formulations for subcutaneous application may include significantly higher concentrations of the antibody of the invention, such as up to 100 mg/ml or even above 100 mg/ml. However, it will be clear to the person skilled in the art that the ingredients and the amounts thereof as given above do only represent one, preferred option. Alternatives and variations thereof will be immediately apparent to the skilled person, or can easily be conceived starting from the above disclosure.

The invention is now described by way of the following non-limiting examples

Example 1A: Prevalence of Both CDH17 and TRAILR2 in Primary and Metastatic Colorectal Cancer (CRC) as Well as in Primary Gastric Cancer (GC) and Pancreatic Cancer (PAC)

A study to evaluate the protein expression of TRAILR2 and CDH17 in different tumor types was performed.

IHC for TRAILR2 and CDH17 on primary CRCs was performed on fresh frozen and OCT embedded samples. 5 μm thick sections were prepared on a cryotome and put on glass slides, followed by fixation in 4% PFA at room temperature and blocking solution (PBS/2% BSA). The sections were incubated with the primary antibodies (anti-TRAILR2 clone TR2.21 from Adipogen #AG-20B-0028, C=10 µg/ml; anti-CDH17 (mulgG1) Clone 141713 from R&D Systems #MAB1032, C=1 µg/ml), followed by detection reagent (TRAILR2 and CDH17: EnVision+, HRP, Mouse, DAKO #4000) and incubation in DAB-solution. Counterstain was performed using hematoxylin. Washing steps in PBS where performed where appropriate. IHC for TRAILR2 and CDH17 on CRC metastases was performed on formalin-fixed and paraffin embedded samples. 2 µm thick sections were prepared on a microtome, put on glass slides and dewaxed. Unmasking solution (TRAILR2: pH9, Vector Laboratories #H3301; CDH17: pH6, Vector Laboratories #H3300) was applied at 121° C./1 bar, followed by blocking steps using 3% H2O2 and subsequently normal goat serum (Vector Laboratories #S-1000) in PBS/2% BSA. The sections were incubated with the primary antibodies (antiTRAILR2 (D4E9) XP® Rabbit mAb from Cell Signaling #8074, dilution 1:20; anti-CDH17 (mulgG1) Clone 141713 from R&D Systems #MAB1032, C=1 µg/ml) for 1 h at room temperature, followed by detection reagent (TRAILR2: EnVision+, HRP, Rabbit, DAKO #K4003; CDH17: EnVision+, HRP, Mouse, DAKO #4000) and incubation in DAB-solution. Counterstain was performed using hematoxylin. Washing steps in PBS were performed where appropriate.

Figure 14:
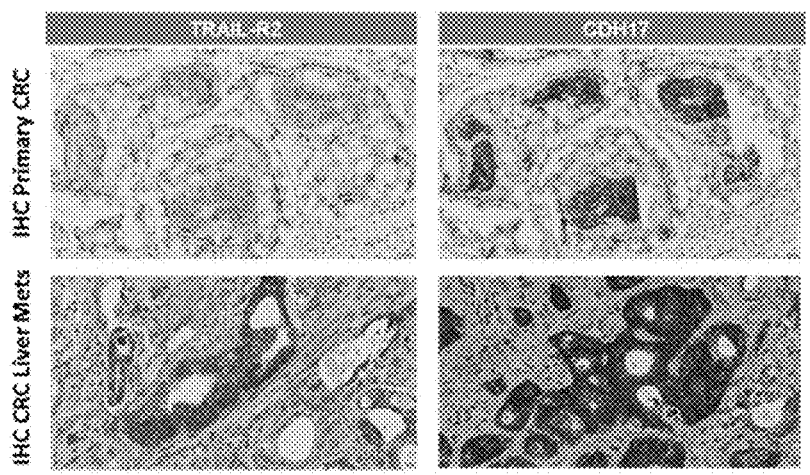
FIG. 14: CDH17 and TRAILR2 protein expression in primary CRC and CRC liver metastasis. Representative images for TRAILR2 and CDH17 using the corresponding primary antibodies followed by detection reagent and incubation in DAB-solution.

In FIG. 14, representative IHC images for both TRAILR2 and CDH17 are shown in primary CRCs and CRC liver metastasis. In primary CRC (n=26), CDH17 expression was observed in 100% of all cases and co-expression with TRAILR2 in 88%; In metastatic CRC (n=39; liver and lung), CDH17 expression was observed in 100% of all cases and co-expression with TRAILR2 in 100%; In primary GC (n=49), CDH17 expression was observed in 95% of all cases and co-expression with TRAILR2 in 60%; In primary PaC (n=32), CDH17 expression was observed in 80% of all cases and co-expression with TRAILR2 in 20%.

This study supports the co-expression of CDH17 and TRAILR2 in a large subset of CRC, GC and PAC.

Example 1B: Design of Binding Molecules Recognizing Human TRAIL Receptor 2 (TRAILR2) and Human Cadherin17 (CDH17)

The present inventors have developed binding molecules that bind CDH17 and TRAILR2 and that induces apoptosis in cancer cells expressing both CDH17 and TRAILR2. The molecular design used has an IgG antibody (termed the "master antibody") which has specificity for one target antigen, with scFvs of different specificities coupled to the C terminus of the heavy chain. A schematic of the design is shown in FIG. 1.

Preferably the binding molecule is bispecific and tetravalent.

The bispecific molecule contains flexible peptide sequences between the variable heavy (VH) and variable light (VL) domains of the scFv, and the scFv domains are linked to the master IgG antibody via further series of linkers. In one configuration, the scFv is oriented such that the VL domain forms the "N-terminal" end of the scFv and is thus fused to the C-terminus of the heavy chain of the master antibody while the VH forms the C-terminus of the scFv and indeed the whole heavy chain polypeptide. However, it can be appreciated that this "N-VL-VH-C" structure can be reversed, i.e. "N-VH-VL-C".

Figure 1B:
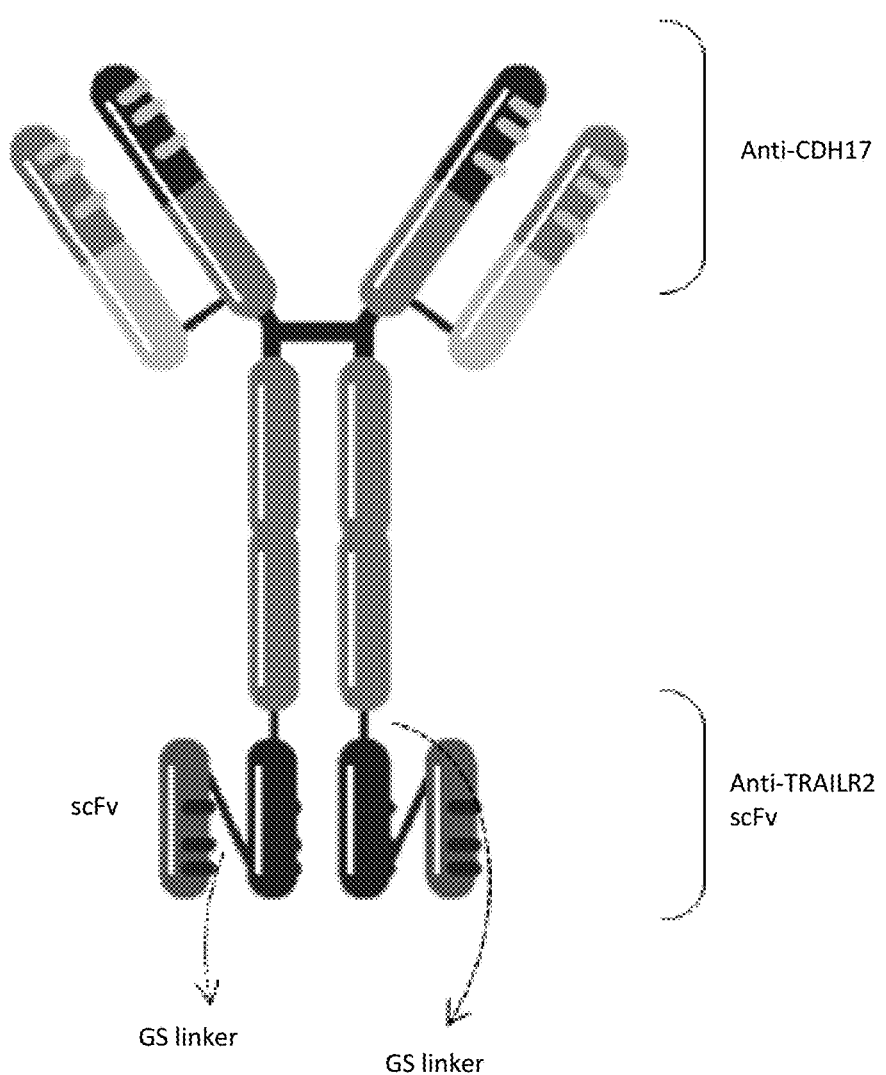

To test feasibility of this concept, a number of different bispecific molecules based on the format depicted in FIG. 1 were prepared.

The following Examples explain the methods used to generate the bispecific molecule that binds CDH17 and TRAILR2 as well as variations in the format and the biological activity of these molecules.

Example 2: Preparation of Binding Domains that Recognise CDH17 and TRAILR2 Using High Throughput V Gene Recovery from Hybridomas and Cultured Single B Cells As can be appreciated, to prepare bispecific molecules binding to human CDH17 and TRAILR2, it is necessary to obtain variable domains bind to the individual target antigens.

To achieve this, clonal hybridomas or single B cells derived from CDH17 or TRAILR2 immunized mice were cultured in vitro. Supernatants were screened for reactivity against human CDH17 or TRAILR2 Immunoglobulin (Ig) VH and VL genes were then amplified from identified positive clones.

To isolate RNA from hybridomas, about 2×10$^6$ cells from single clones were pelleted and used as source material. For single B cells, 100 to 500 cells expanded from singularly isolated B cells were used as source material. RNA was isolated using RNeasy Plus (Qiagen, Hilden, Germany) .cDNA was then synthesized using Smarter cDNA synthesis kit (Clontech, Mount View, Calif.) according to manufacturer's instructions.

Ig VH and VL genes were amplified using primers listed in Table 1. Each 50 µl PCR reaction consisted of 20 µM of the forward and reverse primer mix, 25 µl of Pfu premix (Agilent Technologies), 2 µl of unpurified cDNA, and 21 µl of double-distilled H$_2$O. The PCR reaction began with a 94° C. step for 3 min, followed by 15 PCR cycles (92° C. for 1 min, 55° C. for 1 min, 68° C. for 1 min), then 25 PCR cycles (94° C. for 1 min, 50° C. for 1 min, 72° C. for 1 min), and ends with a 72° C. step for 7 min.

A second-round PCR was then performed with a primer set barcoded for 454 next-generation sequencing. The reaction was started at 94° C. for 3 min, then cycled 35 rounds at 92° C. for 1 min, 53° C. for 1 min, and 68° C. for 1 min VL and VH PCR products were pooled together gel purified, then submitted for 454 DNA sequencing (Roche GS-FLX, SeqWright, U.S.A.).

Using this methodology, a large number of pairs of Ig VH and VL genes encoding binding domains with specificity for CDH17 or TRAILR2 were prepared. Some of the VH and VL sequences were further humanized using methods known in the art.

TABLE 1

| PCR | Primer | 5'-3' sequence |
|---|---|---|
| VL 1st PCR | 5' UPM Long | CTAATACGACTCACTATAGGGCAAGCAGTGGTA TCAACGCAGAGT (SEQ ID NO: 234) |
| | 5' UPM Short | CTAATACGACTCACTATAGGG (SEQ ID NO: 235) |
| | 3'MKC R | CTGCTCACTGGATGGTGGGAAGATGG (SEQ ID NO: 236) |

TABLE 1-continued

PrimerSequences

| PCR | Primer | 5'-3' sequence |
|---|---|---|
| VH 1st PCR | 5' UPM Long | CTAATACGACTCACTATAGGGCAAGCAGTGGTATCAACGCAGAGT (SEQ ID NO: 234) |
| | 5' UPM Short | CTAATACGACTCACTATAGGGC (SEQ ID NO: 235) |
| | 3'MHGC R | GGGGCCAGTGGATAGACAGATGGGGG (SEQ ID NO: 237) |
| 454 2nd VL PCR | MuF1 | CGTATCGCCTCCCTCGCGCCATCAGACGAGTGCGTCTAATACGACTCACTATAGGGC (SEQ ID NO: 238) |
| 454 2nd VL PCR | MuF2 | CGTATCGCCTCCCTCGCGCCATCAGACGCTCGACACTAATACGACTCACTATAGGGC (SEQ ID NO: 239) |
| 454 2nd VL PCR | MuF3 | CGTATCGCCTCCCTCGCGCCATCAGAGACGCACTCCTAATACGACTCACTATAGGGC (SEQ ID NO: 240) |
| 454 2nd VL PCR | MuF4 | CGTATCGCCTCCCTCGCGCCATCAGAGCACTGTAGCTAATACGACTCACTATAGGGC (SEQ ID NO: 241) |
| 454 2nd VL PCR | MuF5 | CGTATCGCCTCCCTCGCGCCATCAGATCAGACACGCTAATACGACTCACTATAGGGC (SEQ ID NO: 242) |
| 454 2nd VL PCR | MuF6 | CGTATCGCCTCCCTCGCGCCATCAGATATCGCGAGCTAATACGACTCACTATAGGGC (SEQ ID NO: 243) |
| 454 2nd VL PCR | MuF7 | CGTATCGCCTCCCTCGCGCCATCAGCGTGTCTCTACTAATACGACTCACTATAGGGC (SEQ ID NO: 244) |
| 454 2nd VL PCR | MuF8 | CGTATCGCCTCCCTCGCGCCATCAGCTCGCGTGTCCTAATACGACTCACTATAGGGC (SEQ ID NO: 245) |
| 454 2nd VL PCR | MuKR 1 | CTATGCGCCTTGCCAGCCCGCTCAGACGAGTGCGTCTGCTCACTGGATGGTGGGAAGATGG (SEQ ID NO: 246) |
| 454 2nd VL PCR | MuKR 2 | CTATGCGCCTTGCCAGCCCGCTCAGACGCTCGACACTGCTCACTGGATGGTGGGAAGATGG (SEQ ID NO: 247) |
| 454 2nd VL PCR | MuKR 3 | CTATGCGCCTTGCCAGCCCGCTCAGAGACGCACTCCTGCTCACTGGATGGTGGGAAGATGG (SEQ ID NO: 248) |
| 454 2nd VL PCR | MuKR 4 | CTATGCGCCTTGCCAGCCCGCTCAGAGCACTGTAGCTGCTCACTGGATGGTGGGAAGATGG (SEQ ID NO: 249) |
| 454 2nd VL PCR | MuKR 5 | CTATGCGCCTTGCCAGCCCGCTCAGATCAGACACGCTGCTCACTGGATGGTGGGAAGATGG (SEQ ID NO: 250) |
| 454 2nd VL PCR | MuKR 6 | CTATGCGCCTTGCCAGCCCGCTCAGATATCGCGAGCTGCTCACTGGATGGTGGGAAGATGG (SEQ ID NO: 251) |
| 454 2nd VL PCR | MuKR 7 | CTATGCGCCTTGCCAGCCCGCTCAGCGTGTCTCTACTGCTCACTGGATGGTGGGAAGATGG (SEQ ID NO: 252) |
| 454 2nd VL PCR | MuKR 8 | CTATGCGCCTTGCCAGCCCGCTCAGCTCGCGTGTCCTGCTCACTGGATGGTGGGAAGATGG (SEQ ID NO: 253) |
| 454 2nd VH PCR | MuF1 | CGTATCGCCTCCCTCGCGCCATCAGACGAGTGCGTCTAATACGACTCACTATAGGGC (SEQ ID NO: 254) |
| 454 2nd VH PCR | MuF2 | CGTATCGCCTCCCTCGCGCCATCAGACGCTCGACACTAATACGACTCACTATAGGGC (SEQ ID NO: 255) |
| 454 2nd VH PCR | MuF3 | CGTATCGCCTCCCTCGCGCCATCAGAGACGCACTCCTAATACGACTCACTATAGGGC (SEQ ID NO: 256) |
| 454 2nd VH PCR | MuF4 | CGTATCGCCTCCCTCGCGCCATCAGAGCACTGTAGCTAATACGACTCACTATAGGGC (SEQ ID NO: 257) |
| 454 2nd VH PCR | MuF5 | CGTATCGCCTCCCTCGCGCCATCAGATCAGACACGCTAATACGACTCACTATAGGGC (SEQ ID NO: 258) |
| 454 2nd VH PCR | MuF6 | CGTATCGCCTCCCTCGCGCCATCAGATATCGCGAGCTAATACGACTCACTATAGGGC (SEQ ID NO: 259) |
| 454 2nd VH PCR | MuF7 | CGTATCGCCTCCCTCGCGCCATCAGCGTGTCTCTACTAATACGACTCACTATAGGGC (SEQ ID NO: 260) |
| 454 2nd VH PCR | MuF8 | CGTATCGCCTCCCTCGCGCCATCAGCTCGCGTGTCCTAATACGACTCACTATAGGGC (SEQ ID NO: 261) |
| 454 2nd VH PCR | MuG1 R1 | CTATGCGCCTTGCCAGCCCGCTCAGACGAGTGCGTGGGGCCAGTGGATAGACAGATGGGGG (SEQ ID NO: 262) |
| 454 2nd VH PCR | MuG1 R2 | CTATGCGCCTTGCCAGCCCGCTCAGACGCTCGACAGGGGCCAGTGGATAGACAGATGGGGG (SEQ ID NO: 263) |
| 454 2nd VH PCR | MuG1 R3 | CTATGCGCCTTGCCAGCCCGCTCAGAGACGCACTCGGGGCCAGTGGATAGACAGATGGGGG (SEQ ID NO: 264) |
| 454 2nd VH PCR | MuG1 R4 | CTATGCGCCTTGCCAGCCCGCTCAGAGCACTGTAGGGGCCAGTGGATAGACAGATGGGGG (SEQ ID NO: 265) |
| 454 2nd VH PCR | MuG1 R5 | CTATGCGCCTTGCCAGCCCGCTCAGATCAGACACGGGGGCCAGTGGATAGACAGATGGGGG (SEQ ID NO: 266) |
| 454 2nd VH PCR | MuG1 R6 | CTATGCGCCTTGCCAGCCCGCTCAGATATCGCGAGGGGGCCAGTGGATAGACAGATGGGGG (SEQ ID NO: 267) |
| 454 2nd VH PCR | MuG1 R7 | CTATGCGCCTTGCCAGCCCGCTCAGCGTGTCTCTAGGGGCCAGTGGATAGACAGATGGGGG (SEQ ID NO: 268) |
| 454 2nd VH PCR | MuG1 R8 | CTATGCGCCTTGCCAGCCCGCTCAGCTCGCGTGTCGGGGCCAGTGGATAGACAGATGGGGG (SEQ ID NO: 269) |

Example 3: High Throughput Construction of Bispecific Molecules Binding CDH17 and TRAILR2

To construct the gene segment encoding the TRAILR2 scFv, pairs of VL and VH genes encoding TRAILR2-binding variable domains prepared in Example 2 or known in the art were joined by a gene segment encoding a flexible linker of peptide sequence GGGGSGGGGSGGGGS- GGGGS (SEQ ID NO:143). The resulting scFv-encoding gene segments were in turn cloned in-frame to the 3' end of a gene encoding the heavy chain of a human IgG antibody. These coding segments were synthesized by overlapping PCR methods and cloned into the expression vector pTT5.

The pairs of VL and VH genes encoding CDH17-binding variable domains prepared in Example 2 were then formatted into the bispecific format outlined in Example 1. The VH genes were cloned into pTT5 expression vector as an in frame fusion at the 5' end of a gene encoding human Igγ. A gene encoding a TRAILR2-binding scFv was cloned in frame at the 3' end of the same Igγ encoding segment. Similarly, the VL genes were cloned into pTT5 expression vector as an in-frame fusion with a gene encoding human IgG kappa light chain.

The pairs of VL and VH genes encoding TRAILR2-binding variable domains prepared in Example 2 or known in the art were further used to prepare antibody molecules (full length antibody molecules comprising two light and two heavy chains) specifically binding to TRAILR2 (e.g. comprising antigen binding site TR2v1 or TRv2) using methods known in the art and used for detecting/labelling cells or as control antibodies in the examples described below. Such antibodies include either human IgG1 WT or IgG1 (KO) constant domains.

Similarly, the pairs of VL and VH genes encoding CDH17-binding variable domains prepared in Example 2 or known in the art were further used to prepare antibody molecules (full length antibody molecules comprising two light and two heavy chains) specifically binding to CDH17 (e.g. comprising antigen binding site CDH17v1 or CDH17H2) using methods known in the art and used for detecting/labelling cells or as control antibodies in the examples described below. Such antibodies include either human IgG1 WT or IgG1 (KO) constant domains.

Antibodies specific for either TRAILR2 or CDH17 described above and used in the following examples as control antibodies are conventional full length antibodies with two heavy and light chains. The binding sites of such control antibodies are defined by the same variable domains as the bispecific binding proteins they are compared to. For example, in FIG. 3 a binding molecule with a CDH17-specific binding site CDH17v1 and a TRAILR2 specific binding site TR2v1 (referred to as binding molecule CDH17v1/TR2v1) comprises VH sequence specific for CDH17 of SEQ ID NO: 118 and VL sequence specific for CDH17 of SEQ ID NO:119 and a VH sequence specific for TRAILR2 of SEQ ID NO. 96 and a VL sequence specific for TRAILR2 of SEQ ID NO: 97 (see table 2). Accordingly, control antibody anti-CDH17v1 used in this example comprises VH sequence specific for CDH17 of SEQ ID NO: 118 and VL sequence specific for CDH17 of SEQ ID NO:119 and control antibody anti-TRv1 comprises a VH sequence specific for TRAILR2 of SEQ ID NO. 96 and a VL sequence specific for TRAILR2 of SEQ ID NO: 97 (see FIG. 3).

In-Fusion® HD Cloning Kit (Clonetech, U.S.A.) was used in the above procedure for directional cloning of VH and VL genes. PCR primers for VL/VH with 15 bp extensions complementary to the ends of the linearized vector were synthesized. PCR was performed using the manufacturer's standard protocol and the amplicons were purified or treated with Cloning Enhancer, then cloned into the appropriate vector. *E. coli* were then transformed according to manufacturer's instructions (Clonetech, U.S.A.). DNA minipreps were sequenced.

Each expression vector contains eukaryotic promoter elements for the chain-encoding gene, the gene encoding the signal sequence and the heavy or light chain, an expression cassette for a prokaryotic selection marker gene such as ampicillin, and an origin of replication. These DNA plasmids were propagated in ampicillin resistant *E. coli* colonies and purified.

Example 4: Expression and Purification of Bispecific, Tetravalent Molecules Recognizing Human TRAILR2 and Human CDH17

The expression vectors prepared in Example 3 were transfected into CHO-E cells.

Transfected CHO-E cells growing in suspension in serum-free media were cultivated in shake flasks under agitation at 140 rpm, 37° C. and 5% $CO_2$ and kept at conditions of exponential growth. On the day of transfection, cells were chemically transfected with 1 mg of light chain plasmid and 0.5 mg of heavy chain plasmid. They were then seeded at 1 to $2\times10^6$ cells/ml in 1 L of Gibco® FreeStyle™ CHO expression medium (LifeTechnologies, NY, US). Cells were then incubated under orbital shaking for 10 to 12 days with one-time feeding of 150 ml commercial feed solution to allow expression of the proteins. Antibody/binding molecule titers in the cell culture supernatants were determined using an Octet® instrument (Pall ForteBio, Calif., US) and protA biosensor tips according to manufacturer's instructions.

Recombinant binding molecules or antibodies were purified from culture supernatant by Protein A affinity chromatography using MabSelect™ (Amersham Biosciences) and stored in 60 mM NaOAc buffer (pH 5.0). Purity and degree of heterogeneity of the samples were assessed by mass spectrometry and analytical ultracentrifugation. All samples were confirmed to have a monomer content of ≥90% and contain <10% impurities prior to functional testing.

Example 5: Details of the Bispecific Molecules Recognizing Human TRAILR2 and Human CDH17 Molecules Prepared In the following examples a number of different bispecific TRAILR2/CDH17 antibody molecules of the invention were prepared. To avoid confusion, the characteristics and sequences of these molecules are provided below.

TABLE 2

Details of the bispecific TRAILR2/CDH17 molecules of the invention

| Name | TRAIL/R2 binding domain (VH and VL sequences) | CDH17 binding domain (VH and VL sequences) | IgG type and sequence | scFV orientation and sequence |
| --- | --- | --- | --- | --- |
| CDH17v1/TR2v1 | TR2v1 SEQ ID NOs 96 and 97. | CDH17v1 SEQ ID NOs 118 and 119. | IgG1 wild type sequence SEQ ID NO 120 | VL-VH SEQ ID NO: 124. |

TABLE 2-continued

Details of the bispecific TRAILR2/CDH17 molecules of the invention

| Name | TRAIL/R2 binding domain (VH and VL sequences) | CDH17 binding domain (VH and VL sequences) | IgG type and sequence | scFV orientation and sequence |
|---|---|---|---|---|
| CDH17v1/TR2v1-(IgG1 KO) | TR2v1 SEQ ID NOs 96 and 97. | CDH17v1 SEQ ID NOs 118 and 119. | IgG1 KO SEQ ID NO: 121 | VL-VH SEQ ID NO: 124. |
| CDH17v1/TR2v2-(IgG1 KO) | TR2v2 SEQ ID NOs 98 and 99. | CDH17v1 SEQ ID NOs 118 and 119 | IgG1 KO SEQ ID NO: 121 | VL-VH SEQ ID NO: 125. |
| CDH17v1/TR2v2-(IgG4 Pro) | TR2v2 SEQ ID NOs 98 and 99 | CDH17v1 SEQ ID NOs 118 and 119 | IgG4 Pro sequence SEQ ID NO: 122 | VL-VH SEQ ID NO: 125. |
| CDH17v1/TR2v1-(scFv VH-VL) | TR2v1 SEQ ID NOs 96 and 97. | CDH17v1 SEQ ID NOs 118 and 119 | IgG1 KO SEQ ID NO: 121 | VH-VL SEQ ID NO. 131 |
| CDH17v1/TR2v1-(scFv VH-VL ss) | TR2v1 SEQ ID NOs 96 and 97. | CDH17v1 SEQ ID NOs 118 and 119 | IgG1 KO SEQ ID NO: 121 | VH-VL SEQ ID NO. 132 |
| CDH17v1/TR2v1-(scFv VL-VH ss) | TR2v1 SEQ ID NOs 96 and 97. | CDH17v1 SEQ ID NOs 118 and 119 | IgG1 KO SEQ ID NO: 121 | VL-VH SEQ ID NO. 133 |
| CDH17A6/TR2v2-(IgG1 KO) | TR2v2 SEQ ID NOs 98 and 99 | CDH17A6 SEQ ID NOs 112 and 113 | IgG1 KO SEQ ID NO: 121 | VL-VH SEQ ID NO 125. |
| CDH17E2/TR2v2-(IgG1 KO) | TR2v2 SEQ ID NOs 98 and 99 | CDH17E2 SEQ ID NOs 114 and 115 | IgG1 KO SEQ ID NO: 121 | VL-VH SEQ ID NO. 125 |
| CDH17E9/TR2v2-(IgG1 KO) | TR2v2 SEQ ID NOs 98 and 99 | CDH17E9 SEQ ID NOs 110 and 111 | IgG1 KO SEQ ID NO: 121 | VL-VH SEQ ID NO. 125 |
| CDH17H2/TR2v2-(IgG1 KO) | TR2v2 SEQ ID NOs 98 and 99 | CDH17H2 SEQ ID NOs 116 and 117 | IgG1 KO SEQ ID NO: 121 | VL-VH SEQ ID NO. 125 |
| CDH17H2/TR2v3-(IgG1 KO | TR2v3 SEQ ID NOs 100 and 101 | CDH17H2 SEQ ID NOs 116 and 117 | IgG1 KO SEQ ID NO: 121 | VL-VH SEQ ID NO. 126 |
| CDH17H2/TR2v4-(IgG1 KO) | TR2v4 SEQ ID NOs 102 and 103 | CDH17H2 SEQ ID NOs 116 and 117 | IgG1 KO SEQ ID NO: 121 | VL-VH SEQ ID NO. 127 |
| CDH17H2/TR2v5-(IgG1 KO) | TR2v5 SEQ ID NOs 104 and 105 | CDH17H2 SEQ ID NOs 116 and 117 | IgG1 KO SEQ ID NO: 121 | VL-VH SEQ ID NO. 128 |
| CDH17H2/TR2v6-(IgG1 KO) | TR2v6 SEQ ID NOs 106 and 107 | CDH17H2 SEQ ID NOs 116 and 117 | IgG1 KO SEQ ID NO: 121 | VL-VH SEQ ID NO. 129 |
| CDH17H2/TR2v7-(IgG1 KO) | TR2v2 SEQ ID NOs 108 and 109 | CDH17H2 SEQ ID NOs 116 and 117 | IgG1 KO SEQ ID NO: 121 | VL-VH SEQ ID NO. 130 |
| CDH17v1/TR2#1-(IgG1 KO) | TR2#1 SEQ ID NOs 82 and 83 | CDH17v1 SEQ ID NOs 118 and 119 | IgG1 KO SEQ ID NO: 121. | VL-VH SEQ ID NO. 134 |
| CDH17v1/TR2#2-(IgG1 KO) | TR2#2 SEQ ID NOs 84 and 85 | CDH17v1 SEQ ID NOs 118 and 119 | IgG1 KO SEQ ID NO: 121. | VL-VH SEQ ID NO. 135 |
| CDH17v1/TR2#3-(IgG1 KO) | TR2#3 SEQ ID NOs 86 and 87 | CDH17v1 SEQ ID NOs 118 and 119 | IgG1 KO SEQ ID NO: 121. | VL-VH SEQ ID NO. 136 |
| CDH17v1/TR2#7-(IgG1 KO) | TR2#7 SEQ ID NOs 88 and 89 | CDH17v1 SEQ ID NOs 118 and 119 | IgG1 KO SEQ ID NO: 121. | VL-VH SEQ ID NO. 137 |
| CDH17v1/TR2#8-(IgG1 KO) | TR2#8 SEQ ID NOs 90 and 91 | CDH17v1 SEQ ID NOs 118 and 119 | IgG1 KO SEQ ID NO: 121. | VL-VH SEQ ID NO. 138 |
| CDH17v1/TR2#10-(IgG1 KO) | TR2#10 SEQ ID NOs 92 and 93 | CDH17v1 SEQ ID NOs 118 and 119 | IgG1 KO SEQ ID NO: 121. | VL-VH SEQ ID NO. 139 |
| CDH17H2/TR2v2-(IgG1 FcRnmut) | TR2v2 SEQ ID NOs 98 and 99 | CDH17H2 SEQ ID NOs 116 and 117 | IgG1 FcRnmut SEQ ID NO: 270 | VL-VH SEQ ID NO. 125 |

TABLE 3

Amino acid sequences and SEQ ID NOs of CDRs, VH, VL, scFv, light and heavy chains of the binding molecules and antibodies of the invention.

| SEQ ID Number | Brief description of sequence | Sequence |
| --- | --- | --- |
| SEQ ID NO: 1 | TR#1HCCDR1 | DYTFTSYDIN |
| SEQ ID NO: 2 | TR2#1HCCDR2 | WIDPGSGNTKYNEKFKG |
| SEQ ID NO: 3 | TR2#1HCCDR3 | KNYGGSYAFTY |
| SEQ ID NO: 4 | TR2#1LCCDR1 | KASQDVITAVA |
| SEQ ID NO: 5 | TR2#1LCCDR2 | WASTRHT |
| SEQ ID NO: 6 | TR2#1LCCDR3 | QQHYSTPWT |
| SEQ ID NO: 7 | TR2#2HCCDR1 | GYTFTEYIIH |
| SEQ ID NO: 8 | TR2#2HCCDR2 | WFYPGSGSIKYNEKEKD |
| SEQ ID NO: 9 | TR2#2HCCDR3 | HEEGGYSAWFPY |
| SEQ ID NO: 10 | TR2#2LCCDR1 | KASQDVSTAVA |
| SEQ ID NO: 11 | TR2#2LCCDR2 | WASTRHT |
| SEQ ID NO: 12 | TR2#2LCCDR3 | QQHYSTPYT |
| SEQ ID NO: 13 | TR2#3HCCDR1 | GYTFTDYYLN |
| SEQ ID NO: 14 | TR2#3HCCDR2 | YIYPNNGDTSYNQKFKG |
| SEQ ID NO: 15 | TR2#3HCCDR3 | GSNWIWYFDV |
| SEQ ID NO: 16 | TR2#3LCCDR1 | RSSQSIVHSNGDTYLD |
| SEQ ID NO: 17 | TR2#3LCCDR2 | KVSNRFS |
| SEQ ID NO: 18 | TR2#3LCCDR3 | FRGSHIPPT |
| SEQ ID NO: 19 | TR2#7HCCDR1 | GYSFTDYYIN |
| SEQ ID NO: 20 | TR2#7HCCDR2 | KIGPGSGNTYYNEKIAEG |
| SEQ ID NO: 21 | TR2#7HCCDR3 | TGPFAY |
| SEQ ID NO: 22 | TR2#7LCCDR1 | KASQNVGNNVA |
| SEQ ID NO: 23 | TR2#7LCCDR2 | YASNRYT |
| SEQ ID NO: 24 | TR2#7LCCDR3 | QQHYSSPLT |
| SEQ ID NO: 25 | TR2#8HCCDR1 | GFSLSTSGMGVS |
| SEQ ID NO: 26 | TR2#8HCCDR2 | HIYWDDDKRYNPSLKS |
| SEQ ID NO: 27 | TR2#8HCCDR3 | RRLGPFAY |
| SEQ ID NO: 28 | TR2#8LCCDR1 | KASQDVGTAVA |
| SEQ ID NO: 29 | TR2#8LCCDR2 | WASTRHT |
| SEQ ID NO: 30 | TR2#8LCCDR3 | QQYSSYPYT |
| SEQ ID NO: 31 | TR2#10HCCDR1 | GYTFTDYYMN |
| SEQ ID NO: 32 | TR2#10HCCDR2 | YIYPNNGGTRYNQKFKG |
| SEQ ID NO: 33 | TR2#10HCCDR3 | GGNWNWYFDV |
| SEQ ID NO: 34 | TR2#10LCCDR1 | RSSQNIVHSNGNTYLD |
| SEQ ID NO: 35 | TR2#10LCCDR2 | KVSNRFS |
| SEQ ID NO: 36 | TR2#10LCCDR3 | FQGSHVPPT |
| SEQ ID NO: 37 | TR2#12HCCDR1 | GYTFTEYIIH |

TABLE 3-continued

Amino acid sequences and SEQ ID NOs of CDRs, VH, VL, scFv, light and heavy chains of the binding molecules and antibodies of the invention.

| SEQ ID Number | Brief description of sequence | Sequence |
|---|---|---|
| SEQ ID NO: 38 | TR2#12HCCDR2 | WFYPGSGNIKYNEKEKD |
| SEQ ID NO: 39 | TR2#12HCCDR3 | HEGGSNFFPY |
| SEQ ID NO: 40 | TR2#12LCCDR1 | KASQDVSNAVA |
| SEQ ID NO: 41 | TR2#12LCCDR2 | WASTRHN |
| SEQ ID NO: 42 | TR2#12LCCDR3 | QQHYRTPYT |
| SEQ ID NO: 43 | TRv1, TRv2, TRv3, TRv4, TRv5, TRv6 and TRv7 HCCDR1 | GFTFDDYGMS |
| SEQ ID NO: 44 | TRv1 and TRv2 HCCDR2 | GINWNGGSTGYADSVKG |
| SEQ ID NO: 45 | TRv3, TRv4, TRv5 HCCDR2 | GINWSGGSTGYADSVKG |
| SEQ ID NO: 46 | TRv6 HCCDR2 | GINWAGGSTGYADSVKG |
| SEQ ID NO: 47 | TRv7 HCCDR2 | GINWTGGSTGYADSVKG |
| SEQ ID NO: 48 | TRv1, TRv2, TRv3, TRv4, TRv5, TRv6 and TRv7 HCCDR3 | ILGAGRGWYFDL |
| SEQ ID NO: 49 | TRv1, TRv2, TRv3, TRv4, TRv5, TRv6 and TRv7 LCCDR1 | QGDSLRSYYAS |
| SEQ ID NO: 50 | TRv1, TRv2 and TRv5 LCCDR2 | GKNNRPS |
| SEQ ID NO: 51 | TRv3 and TRv6 LCCDR2 | GKTNRPS |
| SEQ ID NO: 52 | TRv4 LCCDR2 | GKANRPS |
| SEQ ID NO: 53 | TRv7 LCCDR2 | GKDNRPS |
| SEQ ID NO: 54 | TRv1 and TRv2 LCCDR3 | NSRDSSGNHVV |
| SEQ ID NO: 55 | TRv3 LCCDR3 | NSRDSSGTHVV |
| SEQ ID NO: 56 | TRv4 and TRv5 LCCDR3 | NSRDSSGAHVV |
| SEQ ID NO: 57 | TRv6 and TRv7 LCCDR3 | NSRDSSGDHVV |
| SEQ ID NO: 58 | CDH17E9HCCDR1 | GYTLTDHTIH |
| SEQ ID NO: 59 | CDH17E9HCCDR2 | YIYPRDDITQYNENFKA |
| SEQ ID NO: 60 | CDH17E9HCCDR3 | WSWHFGSNYYGLDY |
| SEQ ID NO: 61 | CDH17E9LCCDR1 | KASQNVGTALA |
| SEQ ID NO: 62 | CDH17E9LCCDR2 | SASNRFT |
| SEQ ID NO: 63 | CDH17E9LCCDR3 | QQYSTYPLT |
| SEQ ID NO: 64 | CDH17A6HCCDR1 | GYTFTDHTIH |

TABLE 3-continued

Amino acid sequences and SEQ ID NOs of CDRs, VH, VL, scFv, light and heavy chains of the binding molecules and antibodies of the invention.

| SEQ ID Number | Brief description of sequence | Sequence |
|---|---|---|
| SEQ ID NO: 65 | CDH17A6HCCDR2 | YIYPRDAITKYNEKFKG |
| SEQ ID NO: 66 | CDH17A6HCCDR3 | WGYYFGSTSYYFDF |
| SEQ ID NO: 67 | CDH17A6LCCDR1 | KASQNVGTGVV |
| SEQ ID NO: 68 | CDH17A6LCCDR2 | SPSNRYT |
| SEQ ID NO: 69 | CDH17A6LCCDR3 | QQYSTYPWT |
| SEQ ID NO: 70 | CDH17E2HCCDR1 CDH17H2HCCDR1 | GYTFTDHTIH |
| SEQ ID NO: 71 | CDH17E2HCCDR2 CDH17H2HCCDR2 | YIYPRDVITQYNEKFKG |
| SEQ ID NO: 72 | CDH17E2HCCDR3 CDH17H2HCCDR3 | WGYFYGSRSYYFDY |
| SEQ ID NO: 73 | CDH17E2LCCDR1 CDH17H2LCCDR1 | KASQNVGTAVA |
| SEQ ID NO: 74 | CDH17E2LCCDR2 CDH17H2LCCDR2 | SASNRYT |
| SEQ ID NO: 75 | CDH17E2LCCDR3 CDH17H2LCCDR3 | QQYSSYPWT |
| SEQ ID NO: 76 | CDH17v1HCCDR1 | GYTLTDHTIH |
| SEQ ID NO: 77 | CDH17v1HCCDR2 | YIYPRDGITGYNEKFKG |
| SEQ ID NO: 78 | CDH17v1HCCDR3 | WGYSYRNYAYYYDY |
| SEQ ID NO: 79 | CDH17v1LCCDR1 | KSSQSLLHSSNQKNYLA |
| SEQ ID NO: 80 | CDH17v1LCCDR2 | WASTRES |
| SEQ ID NO: 81 | CDH17v1LCCDR3 | QQYYSYPWT |
| SEQ ID NO: 82 | TR2#1VH | QVQLQQSGAELVKPGASVKLSCKAFDYTFTSYDINWVKQ RPGQGLEWIGWIDPGSGNTKYNEKFKGKATLTADKSSST AYMHLSSLTSEDSAVYFCARKNYGGSYAFTYWGQGTLVT VSA |
| SEQ ID NO: 83 | TR2#1VL | DIVMTQSHKFMSTSVGDRVSITCKASQDVITAVAWYQQK PGQSPKLLIYWASTRHTGVPDRFTGTGSGTDYTLTISSV QAEDLALYYCQQHYSTPWTFGGGTKLEIK |
| SEQ ID NO: 84 | TR2#2VH | KVQLQQSGAELVKTGTSVKLSCKASGYTFTEYIIHWVKQ RSGQGLEWIGWFYPGSGSIKYNEKFKDKATLTADKSSST VYMELSRLTSEDSAVYFCARHEEGGYSAWFPYWGQGTLV TVSA |
| SEQ ID NO: 85 | TR2#2VL | DIVMTQSHKFMSTSVGDRVSITCKASQDVSTAVAWYQQK PGQSPKVLIYWASTRHTGVPDRFTGSGSGTDYILTISSV QAEDLALYYCQQHYSTPYTFGGGTKLEIK |
| SEQ ID NO: 86 | TR2#3VH | EVQLQQSGPELVKPGASVKISCKASGYTFTDYYLNWVK QSHGKSLEWIGYIYPNNGDTSYNQKFKGKTTLTVDKSSS TAYMEFRSLTSEDSAVYYCTRGSNWIWYFDVWGTGTTVT VSS |
| SEQ ID NO: 87 | TR2#3VL | DVLMTQTPLSLPVSLGDQASISCRSSQSIVHSNGDTYLD WYLQKPGQSPKLLIYKVSNRFSGVPDRFSGSGSGTDFTL KISRVVAEDLGVYYCFRGSHIPPTFGAGTKLELK |
| SEQ ID NO: 88 | TR2#7VH | QVQLKQSGAELVKPGASVKISCKASGYSFTDYYINWVKQ RPGQGLEWIGKIGPGSGNTYYNEKIAEGKATLTADKSSS TAYMQLSSLTSEDSAVYFCASTGPFAYWGQGTLVTWSA |
| SEQ ID NO: 89 | TR2#7VL | SIVMTQTPKFLPVSAGDRVTMTCKASQNVGNNVAWYQQK PGQSPKLLISYASNRYTGVPDRFTGSGSGTDFTFTISSV QVEDLAVYFCQQHYSSPLTFGAGTKLELK |

TABLE 3-continued

Amino acid sequences and SEQ ID NOs of CDRs, VH, VL, scFv, light and heavy chains of the binding molecules and antibodies of the invention.

| SEQ ID Number | Brief description of sequence | Sequence |
|---|---|---|
| SEQ ID NO: 90 | TR2#8VH | QVTLKESGPGILQPSQTLSLTCSFSGFSLSTSGMGVSWI RQPSGKGLEWLAHIYWDDDKRYNPSLKSRLTISKDTSRN QVFLKITSVDTADTATYYCARRRLGPFAYWGQGTLVTVS A |
| SEQ ID NO: 91 | TR2#8VL | DIVMTQSHKFMSTSVGDRVSITCKASQDVGTAVAWYQQK PGQSPKWYWASTRHTGVPDRFTGSGSGTDFTLTISNVQS EDLADYFCQQYSSYPYTEGGGTKLEIK |
| SEQ ID NO: 92 | TR2#10VH | EVQLQQSGPELVKPGASVKISCKASGYTFTDYYMNWVK QSHGKSLEWIGYIYPNNGGTRYNQKFKGKATLTVDKSSS TAYMELRSLTSEDSAVYYCARGGNWNWYFDVWGTGTTVT VSS |
| SEQ ID NO: 93 | TR2#10VL | DVLMTQTPLSLPVSLGDQASISCRSSQNIVHSNGNTYLD WYLQKPGQSPKLLIYKVSNRFSGVPDRFSGSGSGTDFTL KISRVEAEDLGVYYCFQGSHVPPTFGAGTKLELK |
| SEQ ID NO: 94 | TR2#12VH | KVQLQQSGAELVKPGASVKLSCKASGYTFIEYIIHWVKQ KSGQGLEWIGWFYPGSGNIKYNEKFKDKATLTADKSSST VYMELSRLTSEDSAVYFCTRHEGGSNFFPYWGQGTLVTV SA |
| SEQ ID NO: 95 | TR2#12VL | DIVMTQSHKFMSTSVGDRVSITCKASQDVSNAVAWYQQK PGQSPKLLIYWASTRHNGVPDRFTGSGSGTDYILTISSV QAEDLALYYCQQHYRTPYTFGGGTKLEIK |
| SEQ ID NO: 96 | TRv1 VH | EVQLVQSGGGVERPGGSLRLSCAASGFTFDDYGMSWVRQ APGKGLEWVSGINWNGGSTGYADSVKGRVTISRDNAKNS LYLQMNSLRAEDTAVYYCAKILGAGRGWYFDLWGKGTTV TVSS |
| SEQ ID NO: 97 | TRv1 VL | DIELTQDPAVSVALGQTVRITCQGDSLRSYYASWYQQKP GQAPVLVIYGKNNRPSGIPDRFSGSSSGNTASLTITGAQ AEDEADYYCNSRDSSGNHVVEGGGTKLTVL |
| SEQ ID NO: 98 | TRv2VH | EVQLVQSGGGVERPGGSLRLSCAASGFTFDDYGMSWVRQ APGKGLEWVSGINWNGGSTGYADSVKGRVTISRDNAKNS LYLQMNSLRAEDTAVYYCAKILGAGRGWYFDLWGKGTTV TVSS |
| SEQ ID NO: 99 | TRv2VL | SSELTQDPAVSVALGQTVRITCQGDSLRSYYASWYQQKP GQAPVLVIYGKNNRPSGIPDRFSGSSSGNTASLTITGAQ AEDEADYYCNSRDSSGNHVVEGGGTKLTVL |
| SEQ ID NO: 100 | TRv3VH | EVQLVQSGGGVERPGGSLRLSCAASGFTFDDYGMSWVRQ APGKGLEWVSGINWSGGSTGYADSVKGRVTISRDNAKNS LYLQMNSLRAEDTAVYYCAKILGAGRGWYFDLWGKGTTV TVSS |
| SEQ ID NO: 101 | TRv3VL | SSELTQDPAVSVALGQTVRITCQGDSLRSYYASWYQQKP GQAPVLVIYGKTNRPSGIPDRFSGSSSGNTASLTITGAQ AEDEADYYCNSRDSSGTHVVFGGGTKLTVL |
| SEQ ID NO: 102 | TRv4VH | EVQLVQSGGGVERPGGSLRLSCAASGFTFDDYGMSWVRQ APGKGLEWVSGINWSGGSTGYADSVKGRVTISRDNAKNS LYLQMNSLRAEDTAVYYCAKILGAGRGWYFDLWGKGTTV TVSS |
| SEQ ID NO: 103 | TRv4VL | SSELTQDPAVSVALGQTVRITCQGDSLRSYYASWYQQKP GQAPVLVIYGKANRPSGIPDRFSGSSSGNTASLTITGAQ AEDEADYYCNSRDSSGAHVVFGGGTKLTVL |
| SEQ ID NO: 104 | TRv5VH | EVQLVQSGGGVERPGGSLRLSCAASGFTFDDYGMSWVRQ APGKGLEWVSGINWSGGSTGYADSVKGRVTISRDNAKNS LYLQMNSLRAEDTAVYYCAKILGAGRGWYFDLWGKGTTV TVSS |
| SEQ ID NO: 105 | TRv5VL | SSELTQDPAVSVALGQTVRITCQGDSLRSYYASWYQQKP GQAPVLVIYGKNNRPSGIPDRFSGSSSGNTASLTITGAQ AEDEADYYCNSRDSSGNHVVEGGGTKLTVL |

TABLE 3-continued

Amino acid sequences and SEQ ID NOs of CDRs, VH, VL, scFv, light and heavy chains of the binding molecules and antibodies of the invention.

| SEQ ID Number | Brief description of sequence | Sequence |
|---|---|---|
| SEQ ID NO: 106 | TRv6VH | EVQLVQSGGGVERPGGSLRLSCAASGFTFDDYGMSWVRQ APGKGLEWVSGINWAGGSTGYADSVKGRVTISRDNAKNS LYLQMNSLRAEDTAVYYCAKILGAGRGWYFDLWGKGTTV TVSS |
| SEQ ID NO: 107 | TRv6VL | SSELTQDPAVSVALGQTVRITCQGDSLRSYYASWYQQKP GQAPVLVIYGKTNRPSGIPDRFSGSSSGNTASLTITGAQ AEDEADYYCNSRDSSGDHVVFGGGTKLTVL |
| SEQ ID NO: 108 | TRv7VH | EVQLVQSGGGVERPGGSLRLSCAASGFTFDDYGMSWVRQ APGKGLEWVSGINWTGGSTGYADSVKGRVTISRDNAKNS LYLQMNSLRAEDTAVYYCAKILGAGRGWYFDLWGKGTTV TVSS |
| SEQ ID NO: 109 | TRv7VL | SSELTQDPAVSVALGQTVRITCQGDSLRSYYASWYQQKP GQAPVLVIYGKDNRPSGIPDRFSGSSSGNTASLTITGAQ AEDEADYYCNSRDSSGDHVVEGGGTKLTVL |
| SEQ ID NO: 110 | CDH17E9VH | QVQLQQSDAELVKPGASVKISCKVSGYTLTDHTIHWMKQ RPDQGLDWIGYIYPRDDITQYNENFKAKSTLTADKSSST AYMQLNSLTSEDSAVYFCARWSWHFGSNYYGLDYWGQGT SVTVSS |
| SEQ ID NO: 111 | CDH17E9VL | DIVMTQSQTFMSTTVGDRVSITCKASQNVGTALAWYQQK PRQSPKLLIYSASNRFTGVPDRFTGSGSGTDFTLTISNM RSEDLADYVCQQYSTYPLTFGSGTKLEIR |
| SEQ ID NO: 112 | CDH17A6VH | QVQLQQSDAELVKPGASVKISCKVSGYTFTDHTIHWMKQ RPEQGLEWIGYIYPRDAITKYNEKFKGKATLTADKSSST AYMQLNSLTSEDSAVYFCARWGYYFGSTSYYFDFVVGQG TTLTVSS |
| SEQ ID NO: 113 | CDH17A6VL | DIVMTQSQKFMSTTVGDRVSITCKASQNVGTGVVWYQQR PGQSPKLLIYSPSNRYTGVPDRFTGSGSGTDFTLTITNI QSEDLADYFCQQYSTYPWTEGGGTKLEIK |
| SEQ ID NO: 114 | CDH17E2VH | QVQLQQSDAELVKPGASVKISCKVSGYTFTDHTIHWMKQ RPEQGLEWIGYIYPRDVITQYNEKFKGKATLTADKSSST AYMQLNSLTSEDSAVYLCARWGYFYGSRSYYFDYWGQGT TLTVSS |
| SEQ ID NO: 115 | CDH17E2VL | DIVMTQSQKFMSTTVGDRVNITCKASQNVGTAVAWYQQK PGQSPKLLIYSASNRYTGVPDRFTGSGSGTDFTLTITNM QSKDLADYFCQQYSSYPWTFGGGTKLEIK |
| SEQ ID NO: 116 | CDH17H2VH | QVQLVQSGAEVKKPGSSVKVSCKVSGYTFTDHTIHWMKQ RPGQGLEWIGYIYPRDVITQYNEKFKGKVTLTADKSTST AYMELSSLRSEDTAVYLCARWGYFYGSRSYYFDYWGQGT TVTVSS |
| SEQ ID NO: 117 | CDH17H2VL | DIQMTQSQSSLSASVGDRVGITCKASQNVGTAVAWYQQK PGKAPKWYSASNRYTGVPSRFSGSGSGTDFTLTISSLQP KDFATYFCQQYSSYPWTFGQGTKLEIK |
| SEQ ID NO: 118 | CDH17v1VH | EVQLQQSVAELVKPGASVKMSCKVSGYTLTDHTIHWMKQ RPEQGLEWIGYIYPRDGITGYNEKFKGKATLTADTSSST AYMQLNSLTSEDSAVYFCARWGYSYRNYAYYYDYWGQGT TLTVSS |
| SEQ ID NO: 119 | CDH17v1VL | DIVMSQSPSSLAVSVGEKVTMSCKSSQSLLHSSNQKNYL AWYQQKPGQSPKVLIYWASTRESGVPDRFTGSGSGTDFT LTITSVKSEDLAVYYCQQYSYPWTFGGGTRLEIK |
| SEQ ID NO: 120 | IgG1WTHC | ASTKGPSVFPLAPSSKSTSGGTAALGCLVKDYFPEPVTV SWNSGALTSGVHTFPAVLQSSGLYSLSSVVTVPSSSLGT QTYICNVNHKPSNTKVDKRVEPKSCDKTHTCPPCPAPEL LGGPSVFLFPPKPKDTLMISRTPEVTCVVVDVSHEDPEV KFNWYVDGVEVHNAKTKPREEQYNSTYRVVSVLTVLHQD WLNGKEYKCKVSNKALPAPIEKTISKAKGQPREPQVYTL PPSRDELTKNQVSLTCLVKGFYPSDIAVEWESNGQPENN YKTTPPVLDSDGSFFLYSKLTVDKSRWQQGNVFSCSVMH EALHNHYTQKSLSLSPGK |

TABLE 3-continued

Amino acid sequences and SEQ ID NOs of CDRs, VH, VL, scFv, light and heavy chains of the binding molecules and antibodies of the invention.

| SEQ ID Number | Brief description of sequence | Sequence |
| --- | --- | --- |
| SEQ ID NO: 121 | IgG1KOHC | ASTKGPSVFPLAPSSKSTSGGTAALGCLVKDYFPEPVTV SWNSGALTSGVHTFPAVLQSSGLYSLSSVVTVPSSSLGT QTYICNVNHKPSNTKVDKRVEPKSCDKTHTCPPCPAPEA AGGPSVFLFPPKPKDTLMISRTPEVTCVVVDVSHEDPEV KFNWYVDGVEVHNAKTKPREEQYNSTYRVVSVLTVLHQD WLNGKEYKCKVSNKALPAPIEKTISKAKGQPREPQVYTL PPSREEMTKNQVSLTCLVKGFYPSDIAVEWESNGQPENN YKTTPPVLDSDGSFFLYSKLTVDKSRWQQGNVFSCSVMH EALHNHYTQKSLSLSPG |
| SEQ ID NO: 122 | IgG4ProHC | ASTKGPSVFPLAPCSRSTSESTAALGCLVKDYFPEPVTV SWNSGALTSGVHTFPAVLQSSGLYSLSSVVTVPSSSLGT KTYTCNVDHKPSNTKVDKRVESKYGPPCPPCPAPEFLGG PSVFLFPPKPKDTLMISRTPEVTCVVVDVSQEDPEVQFN WYVDGVEVHNAKTKPREEQFNSTYRVVSVLTVLHQDWLN GKEYKCKVSNKGLPSSIEKTISKAKGQPREPQVYTLPPS QEEMTKNQVSLTCLVKGFYPSDIAVEWESNGQPENNYKT TPPVLDSDGSFFLYSRLTVDKSRWQEGNVFSCSVMHEAL HNHYTQKSLSLSLGK |
| SEQ ID NO: 123 | Kappa light chain | RTVAAPSVFIFPPSDEQLKSGTASVVCLLNNFYPREAKV QWKVDNALQSGNSQESVTEQDSKDSTYSLSSTLTLSKAD YEKHKVYACEVTHQGLSSPVTKSFNRGEC |
| SEQ ID NO: 124 | TR2v1scFvVLVH | DIELTQDPAVSVALGQTVRITCQGDSLRSYYASWYQQKP GQAPVLVIYGKNNRPSGIPDRFSGSSSGNTASLTITGAQ AEDEADYYCNSRDSSGNHVVFGGGTKLTVLGQGGGSGGG GGSGGGGSGGGGSEVQLVQSGGGVERPGGSLRLSCAASG FTFDDYGMSWVRQAPGKGLEWVSGINWNGGSTGYADSVK GRVTISRDNAKNSLYLQMNSLRAEDTAVYYCAKILGAGR GWYFDLWGKGTTVTVSS |
| SEQ ID NO: 125 | TR2v2scFvVLVH | SSELTQDPAVSVALGQTVRITCQGDSLRSYYASWYQQKP GQAPVLVIYGKNNRPSGIPDRFSGSSSGNTASLTITGAQ AEDEADYYCNSRDSSGNHVVFGGGTKLTVLGGGGSGGGG SGGGGSGGGGSEVQLVQSGGGVERPGGSLRLSCAASGFT FDDYGMSWVRQAPGKGLEWVSGINWNGGSTGYADSVKGR VTISRDNAKNSLYLQMNSLRAEDTAVYYCAKILGAGRGW YFDLWGKGTTVTVSS |
| SEQ ID NO: 126 | TR2v3scFvVLVH | SSELTQDPAVSVALGQTVRITCQGDSLRSYYASWYQQKP GQAPVLVIYGKTNRPSGIPDRFSGSSSGNTASLTITGAQ AEDEADYYCNSRDSSGTHVVFGGGTKLTVLGGGGSGGGG SGGGGSGGGGSEVQLVQSGGGVERPGGSLRLSCAASGFT FDDYGMSWVRQAPGKGLEWVSGINWSGGSTGYADSVKGR VTISRDNAKNSLYLQMNSLRAEDTAVYYCAKILGAGRGW YFDLWGKGTTVTVSS |
| SEQ ID NO: 127 | TR2v4scFvVLVH | SSELTQDPAVSVALGQTVRITCQGDSLRSYYASWYQQKP GQAPVLVIYGKANRPSGIPDRFSGSSSGNTASLTITGAQ AEDEADYYCNSRDSSGAHVVFGGGTKLTVLGGGGSGGGG SGGGGSGGGGSEVQLVQSGGGVERPGGSLRLSCAASGFT FDDYGMSWVRQAPGKGLEWVSGINWSGGSTGYADSVKGR VTISRDNAKNSLYLQMNSLRAEDTAVYYCAKILGAGRGW YFDLWGKGTTVTVSS |
| SEQ ID NO: 128 | TR2v5 scFvVLVH | SSELTQDPAVSVALGQTVRITCQGDSLRSYYASWYQQKP GQAPVLVIYGKNNRPSGIPDRFSGSSSGNTASLTITGAQ AEDEADYYCNSRDSSGNHVVFGGGTKLTVLGGGGSGGGG SGGGGSGGGGSEVQLVQSGGGVERPGGSLRLSCAASGFT FDDYGMSWVRQAPGKGLEWVSGINWSGGSTGYADSVKGR VTISRDNAKNSLYLQMNSLRAEDTAVYYCAKILGAGRGW YFDLWGKGTTVTVSS |
| SEQ ID NO: 129 | TR2v6scFvVLVH | SSELTQDPAVSVALGQTVRITCQGDSLRSYYASWYQQKP GQAPVLVIYGKTNRPSGIPDRFSGSSSGNTASLTITGAQ AEDEADYYCNSRDSSGDHVVFGGGTKLTVLGGGGSGGGG SGGGGSGGGGSEVQLVQSGGGVERPGGSLRLSCAASGFT FDDYGMSWVRQAPGKGLEWVSGINWAGGSTGYADSVKGR VTISRDNAKNSLYLQMNSLRAEDTAVYYCAKILGAGRGW YFDLWGKGTTVTVSS |

TABLE 3-continued

Amino acid sequences and SEQ ID NOs of CDRs, VH, VL, scFv, light and heavy chains of the binding molecules and antibodies of the invention.

| SEQ ID Number | Brief description of sequence | Sequence |
|---|---|---|
| SEQ ID NO: 130 | TR2v7 scFvVLVH | SSELTQDPAVSVALGQTVRITCQGDSLRSYYASWYQQKP GQAPVLVIYGKDNRPSGIPDRFSGSSSGNTASLTITGAQ AEDEADYYCNSRDSSGDHVVFGGGTKLTVLGGGGSGGGG SGGGGSGGGGSEVQLVQSGGGVERPGGSLRLSCAASGFT FDDYGMSWVRQAPGKGLEWVSGINWTGGSTGYADSVKGR VTISRDNAKNSLYLQMNSLRAEDTAVYYCAKILGAGRGW YFDLWGKGTTVTVSS |
| SEQ ID NO: 131 | TR2v1scFvVHVL | EVQLVQSGGGVERPGGSLRLSCAASGFTFDDYGMSWVRQ APGKGLEWVSGINWNGGSTGYADSVKGRVTISRDNAKNS LYLQMNSLRAEDTAVYYCAKILGAGRGWYFDLWGKGTTV TVSSGGGGSGGGGSGGGGSGGGGSDIELTQDPAVSVALG QTVRITCQGDSLRSYYASWYQQKPGQAPVLVIYGKNNRP SGIPDRFSGSSSGNTASLTITGAQAEDEADYYCNSRDSS GNHVVFGGGTKLTVLGQ |
| SEQ ID NO: 132 | TR2v1scFvVHVLss | EVQLVQSGGGVERPGGSLRLSCAASGFTFDDYGMSWVRQ APGKCLEWVSGINWNGGSTGYADSVKGRVTISRDNAKNS LYLQMNSLRAEDTAVYYCAKILGAGRGWYFDLWGKGTTV TVSSGGGGSGGGGSGGGGSGGGGSDIELTQDPAVSVALG QTVRITCQGDSLRSYYASWYQQKPGQAPVLVIYGKNNRP SGIPDRFSGSSSGNTASLTITGAQAEDEADYYCNSRDSS GNHVVFGCGTKLTVLGQ |
| SEQ ID NO: 133 | TR2v1scFvVLVHss | DIELTQDPAVSVALGQTVRITCQGDSLRSYYASWYQQKP GQAPVLVIYGKNNRPSGIPDRFSGSSSGNTASLTITGAQ AEDEADYYCNSRDSSGNHVVFGCGTKLTVLGQGGGGSGG GGSGGGGSGGGGSEVQLVQSGGGVERPGGSLRLSCAASG FTFDDYGMSWVRQAPGKCLEWVSGINWNGGSTGYADSVK GRVTISRDNAKNSLYLQMNSLRAEDTAVYYCAKILGAGR GWYFDLWGKGTTVTVSS |
| SEQ ID NO: 134 | TR2#1scFvVLVH | DIVMTQSHKFMSTSVGDRVSITCKASQDVITAVAWYQQK PGQSPKLLIYWASTRHTGVPDRFTGTGSGTDYTLTISSV QAEDLALYYCQQHYSTPWTFGGGTKLEIKGGGGSGGGGS GGGGSGGGGSQVQLQQSGAELVKPGASVKLSCKAFDYTF TSYDINWVKQRPGQGLEWIGWIDPGSGNTKYNEKFKGKA TLTADKSSSTAYMHLSSLTSEDSAVYFCARKNYGGSYAF TYWGQGTLVTVA |
| SEQ ID NO: 135 | TR2#2scFvVLVH | DIVMTQSHKFMSTSVGDRVSITCKASQDVSTAVAWYQQK PGQSPKVLIYWASTRHTGVPDRFTGSGSGTDYILTISSV QAEDLALYYCQQHYSTPYTFGGGTKLEIKGGGGSGGGGS GGGGSGGGGSKVQLQQSGAELVKTGTSVKLSCKASGYTF ILYIIHWVKQRSGQGLEWIGWFYPGSGSIKYNEKFKDKA TLTADKSSSTVYMELSRLTSEDSAVYFCARHEEGGYSAW FPYWGQGTLVTVSA |
| SEQ ID NO: 136 | TR2#3scFvVLVH | DVLMTQTPLSLPVSLGDQASISCRSSQSIVHSNGDTYLD WYLQKPGQSPKLLIYKVSNRFSGVPDRFSGSGSGTDFTL KISRVVAEDLGVYYCFRGSHIPPTFGAGTKLEKGGGGSG GGGSGGGGSGGGGSEVQLQQSGPELVKPGASVKISCKAS GYTFTDYYYLNWVKQSHGKSLEWIGYIYPNNGDTSYNQK FKGKTTLTVDKSSSTAYMEFRSLTSEDSAVYYCTRGSNW IWYFDVWGTGTTVTVSS |
| SEQ ID NO: 137 | TR2#7scFvVLVH | SIVMTQTPKFLPVSAGDRVTMTCKASQNVGNNVAWYQQK PGQSPKLLISYASNRYTGVPDRFTGSGSGTDFFTISSVQ VEDLAVYFCQQHYSSPLTFGAGTKLELKGGGGSGGGGSG GGGSGGGGSQVQLKQSGAELVKPGASVKISCKASGYSFT DYYINWVKQRPGQGLEWIGKIGPGSGNTYYNEKFLGKAT LTADKSSSTAYMQLSSLTSEDSAVYFCASTGPFAYWGQG TLVTWSA |
| SEQ ID NO: 138 | TR2#8scFvVLVH | DIVMTQSHKFMSTSVGDRVSITCKASQDVGTAVAWYQQK PGQSPKLLIYWASTRHTGVPDRFTGSGSGTDFTLTISNV QSEDLADYFCQQYSSYPYTFGGGTKLEIKGGGGSGGGGS GGGGSGGGGSQVTLKESGPGILQPSQTLSLTCSFSGFSL STSGMGVSWIRQPSGKGLEWLAHIYWDDDKRYNPSLKSR LTISKDTSRNQVFLKITSVDTADTATYYCARRRLGPFAY WGQGTLVTVSA |

TABLE 3-continued

Amino acid sequences and SEQ ID NOs of CDRs, VH, VL, scFv, light and heavy chains of the binding molecules and antibodies of the invention.

| SEQ ID Number | Brief description of sequence | Sequence |
|---|---|---|
| SEQ ID NO: 139 | TR2#10scFvVLVH | DVLMTQTPLSLPVSLGDQASISCRSSQNIVHSNGNTYLD WYLQKPGQSPKLLIYKVSNRFSGVPDRFSGSGSGTDFTL KISRVEAEDLGVYYCFQGSHVPPTFGAGTKLELKGGGGS GGGGSGGGGSGGGGSEVQLQQSGPELVKPGASVKISCKA SGYTFTDYYYMNWVKQSHGKSLEWIGYIYPNNGGTRYNQ KFKGKATLTVDKSSSTAYMELRSLTSEDSAVYYCARGGN WNWYFDVWGTGTTVTVSS |
| SEQ ID NO: 140 | TR2#12scFvVLVH | DIVMTQSHKFMSTSVGDRVSITCKASQDVSNAVAWYQQK PGQSPKLLIYWASTRHNGVPDRFTGSGSGTDYILTISSV QAEDLALYYCQQHYRTPYTFGGGTKLEIKGGGGSGGGGS GGGGSGGGGSKVQLQQSGAELVKPGASVKLSCKASGYTF TEYIIHWVKQKSGQGLEWIGWFYPGSGNIKYNEKFKDKA TLTADKSSSTVYMELSRLTSEDSAVYFCTRHEGGSNFFP YWGQGTLVTVSA |
| SEQ ID NO: 141 | Linker between mAb and scFv | GGSGGS |
| SEQ ID NO: 142 | Extended linker between mAb and scFv | GGGGSGGGGS |
| SEQ ID NO: 143 | VLand VH linker | GGGGSGGGGSGGGGSGGGGS |
| SEQ ID NO: 144 | Linker from scFv to mAb | GGGS |
| SEQ ID NO: 145 | CDH17v1/TR2v1 (VL-VH, IgG1WT) HC | EVQLQQSVAELVKPGASVKMSCKVSGYTLTDHTIHWMKQ RPEQGLEWIGYIYPRDGITGYNEKFKGKATLTADTSSST AYMQLNSLTSEDSAVYFCARWGYSYRNYAYYYDYWGQGT TLTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPELLGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSRDELTKNQVSLTCLVKGFYPSDIAVEWESN GQPENNYKTTPPVLDSDGSFFLYSKLTVDKSRWQQGNVF SCSVMHEALHNHYTQKSLSLSPGKGGSGGSDIELTQDPA VSVALGQTVRITCQGDSLRSYYASWYQQKPGQAPVLVIY GKNNRPSGIPDRFSGSSSGNTASLTITGAQAEDEADYYC NSRDSSGNHVVFGGGTKLTVLGQGGGGSGGGGSGGGGSS GGGSEVQLVQSGGGVERPGGSLRLSCAASGFTFDDYGMS WVRQAPGKGLEWVSGINWNGGSTGYADSVKGRVTISRDN AKNSLYLQMNSLRAEDTAVYYCAKILGAGRGWYFDLWGK GTTVTVSS |
| SEQ ID NO: 146 | CDH17v1/TR2v1 LC | DIVMSQSPSSLAVSVGEKVTMSCKSSQSLLHSSNQKNYL AWYQQKPGQSPKVLIYWASTRESGVPDRFTGSGSGTDFT LTITSVKSEDLAVYYCQQYYSYPWTFGGGTRLEIKRTVA APSVFIFPPSDEQLKSGTASVVCLLNNFYPREAKVQWKV DNALQSGNSQESVTEQDSKDSTYSLSSTLTLSKADYEKH KVYACEVTHQGLSSPVTKSFNRGEC |
| SEQ ID NO: 147 | CDH17v1/TR2v1- (VL-VH, IgG1 KO) HC | EVQLQQSVAELVKPGASVKMSCKVSGYTLTDHTIHWMKQ RPEQGLEWIGYIYPRDGITGYNEKFKGKATLTADTSSST AYMQLNSLTSEDSAVYFCARWGYSYRNYAYYYDYWGQGT TLTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSDIELTQDPAV SVALGQTVRITCQGDSLRSYYASWYQQKPGQAPVLVIYG KNNRPSGIPDRFSGSSSGNTASLTITGAQAEDEADYYCN SRDSSGNHVVFGGGTKLTVLGQGGGGSGGGGSGGGGSGG GGSEVQLVQSGGGVERPGGSLRLSCAASGFTFDDYGMSW VRQAPGKGLEWVSGINWNGGSTGYADSVKGRVTISRDNA KNSLYLQMNSLRAEDTAVYYCAKILGAGRGWYFDLWGKG TTVTVSS |

TABLE 3-continued

Amino acid sequences and SEQ ID NOs of CDRs, VH, VL, scFv, light and heavy chains of the binding molecules and antibodies of the invention.

| SEQ ID Number | Brief description of sequence | Sequence |
|---|---|---|
| SEQ ID NO: 148 | CDH17v1/TR2v1-(IgG1 KO) LC | DIVMSQSPSSLAVSVGEKVTMSCKSSQSLLHSSNQKNYL AWYQQKPGQSPKVLIYWASTRESGVPDRFTGSGSGTDFT LTITSVKSEDLAVYYCQQYYSYPWTFGGGTRLEIKRTVA APSVFIFPPSDEQLKSGTASVVCLLNNFYPREAKVQWKV DNALQSGNSQESVTEQDSKDSTYSLSSTLTLSKADYEKH KVYACEVTHQGLSSPVTKSFNRGEC |
| SEQ ID NO: 149 | CDH17v1/TR2v2-(VL-VH, IgG1 KO) HC | EVQLQQSVAELVKPGASVKMSCKVSGYTLTDHTIHWMKQ RPEQGLEWIGYIYPRDGITGYNEKFKGKATLTADTSSST AYMQLNSLTSEDSAVYFCARWGYSYRNYAYYYDYWGQGT TLTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGGSSSELTQDPAV SVALGQTVRITCQGDSLRSYYASWYQQKPGQAPVLVIYG KNNRPSGIPDRFSGSSSGNTASLTITGAQAEDEADYYCN SRDSSGNHVVFGGGTKLTVLGGGGSGGGGSGGGGSGGGG SEVQLVQSGGGVERPGGSLRLSCAASGFTFDDYGMSWVR QAPGKGLEWVSGINWNGGSTGYADSVKGRVTISRDNAKN SLYLQMNSLRAEDTAVYYCAKILGAGRGWYFDLWGKGTT VTVSS |
| SEQ ID NO: 150 | CDH17v1/TR2v2-(IgG1 KO) LC | DIVMSQSPSSLAVSVGEKVTMSCKSSQSLLHSSNQKNYL AWYQQKPGQSPKVLIYWASTRESGVPDRFTGSGSGTDFT LTITSVKSEDLAVYYCQQYYSYPWTFGGGTRLEIKRTVA APSVFIFPPSDEQLKSGTASVVCLLNNFYPREAKVQWKV DNALQSGNSQESVTEQDSKDSTYSLSSTLTLSKADYEKH KVYACEVTHQGLSSPVTKSFNRGEC |
| SEQ ID NO: 151 | CDH17v1/TR2v2-(VL-VH, IgG4 Pro) HC | EVQLQQSVAELVKPGASVKMSCKVSGYTLTDHTIHWMKQ RPEQGLEWIGYIYPRDGITGYNEKFKGKATLTADTSSST AYMQLNSLTSEDSAVYFCARWGYSYRNYAYYYDYWGQGT TLTVSSASTKGPSVFPLAPCSRSTSESTAALGCLVKDYF PEPVTVSWNSGALTSGVHTFPAVLQSSGLYSLSSVVTVP SSSLGTKTYTCNVDHKPSNTKVDKRVESKYGPPCPPCPA PEFLGGPSVFLFPPKPKDTLMISRTPEVTCVVVDVSQED PEVQFNWYVDGVEVHNAKTKPREEQFNSTYRVVSVLTVL HQDWLNGKEYKCKVSNKGLPSSIEKTISKAKGQPREPQV YTLPPSQEEMTKNQVSLTCLVKGFYPSDIAVEWESNGQP ENNYKTTPPVLDSDGSFFLYSRLTVDKSRWQEGNVFSCS VMHEALHNHYTQKSLSLSLGKGGSGGSSSELTQDPAVSV ALGQTVRITCQGDSLRSYYASWYQQKPGQAPVLVIYGKN NRPSGIPDRFSGSSSGNTASLTITGAQAEDEADYYCNSR DSSGNHVVFGGGTKLTVLGGGGSGGGGSGGGGSGGGGSE VQLVQSGGGVERPGGSLRLSCAASGFTFDDYGMSWVRQA PGKGLEWVSGINWNGGSTGYADSVKGRVTISRDNAKNSL YLQMNSLRAEDTAVYYCAKILGAGRGWYFDLWGKGTTVT VSS |
| SEQ ID NO: 152 | CDH17v1/TR2v2-(IgG4 Pro) LC | DIVMSQSPSSLAVSVGEKVTMSCKSSQSLLHSSNQKNYL AWYQQKPGQSPKVLIYWASTRESGVPDRFTGSGSGTDFT LTITSVKSEDLAVYYCQQYYSYPWTFGGGTRLEIKRTVA APSVFIFPPSDEQLKSGTASVVCLLNNFYPREAKVQWKV DNALQSGNSQESVTEQDSKDSTYSLSSTLTLSKADYEKH KVYACEVTHQGLSSPVTKSFNRGEC |
| SEQ ID NO: 153 | CDH17v1/TR2v1-(scFv VH-VL, IgG1 KO) HC | EVQLQQSVAELVKPGASVKMSCKVSGYTLTDHTIHWMKQ RPEQGLEWIGYIYPRDGITGYNEKFKGKATLTADTSSST AYMQLNSLTSEDSAVYFCARWGYSYRNYAYYYDYWGQGT TLTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGGSEVQLVQSGGG VERPGGSLRLSCAASGFTFDDYGMSWVRQAPGKGLEWVS |

TABLE 3-continued

Amino acid sequences and SEQ ID NOs of CDRs, VH, VL, scFv, light and heavy chains of the binding molecules and antibodies of the invention.

| SEQ ID Number | Brief description of sequence | Sequence |
|---|---|---|
| | | GINWNGGSTGYADSVKGRVTISRDNAKNSLYLQMNSLRA EDTAVYYCAKILGAGRGWYFDLWGKGTTVTVSSGGGGSG GGGSGGGGSGGGGSDIELTQDPAVSVALGQTVRITCQGD SLRSYYASWYQQKPGQAPVLVIYGKNNRPSGIPDRFSGS SSGNTASLTITGAQAEDEADYYCNSRDSSGNHVVFGGGT KLTVLGQ |
| SEQ ID NO: 154 | CDH17v1/TR2v1- (scFv VH-VL) LC | DIVMSQSPSSLAVSVGEKVTMSCKSSQSLLHSSNQKNYL AWYQQKPGQSPKVLIYWASTRESGVPDRFTGSGSGTDFT LTITSVKSEDLAVYYCQQYYSYPWTFGGGTRLEIKRTVA APSVFIFPPSDEQLKSGTASVVCLLNNFYPREAKVQWKV DNALQSGNSQESVTEQDSKDSTYSLSSTLTLSKADYEKH KVYACEVTHQGLSSPVTKSFNRGEC |
| SEQ ID NO: 155 | CDH17v1/TR2v1- (scFv VH-VLss) HC | EVQLQQSVAELVKPGASVKMSCKVSGYTLTDHTIHWMKQ RPEQGLEWIGYIYPRDGITGYNEKFKGKATLTADTSSST AYMQLNSLTSEDSAVYFCARWGYSYRNYAYYYDYWGQGT TLTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSEVQLVQSGGG VERPGGSLRLSCAASGFTFDDYGMSWVRQAPGKCLEWVS GINWNGGSTGYADSVKGRVTISRDNAKNSLYLQMNSLRA EDTAVYYCAKILGAGRGWYFDLWGKGTTVTVSSGGGGSG GGGSGGGGSGGGGSDIELTQDPAVSVALGQTVRITCQGD SLRSYYASWYQQKPGQAPVLVIYGKNNRPSGIPDRFSGS SSGNTASLTITGAQAEDEADYYCNSRDSSGNHVVFGCGT KLTVLGQ |
| SEQ ID NO: 156 | CDH17v1/TR2v1- (scFv VH-VLss) LC | DIVMSQSPSSLAVSVGEKVTMSCKSSQSLLHSSNQKNYL AWYQQKPGQSPKVLIYWASTRESGVPDRFTGSGSGTDFT LTITSVKSEDLAVYYCQQYYSYPWTFGGGTRLEIKRTVA APSVFIFPPSDEQLKSGTASVVCLLNNFYPREAKVQWKV DNALQSGNSQESVTEQDSKDSTYSLSSTLTLSKADYEKH KVYACEVTHQGLSSPVTKSFNRGEC |
| SEQ ID NO: 157 | CDH17v1/TR2v1- (scFv VL-VH ss, IgG1 KO) HC | EVQLQQSVAELVKPGASVKMSCKVSGYTLTDHTIHWMKQ RPEQGLEWIGYIYPRDGITGYNEKFKGKATLTADTSSST AYMQLNSLTSEDSAVYFCARWGYSYRNYAYYYDYWGQGT TLTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSDIELTQDPAV SVALGQTVRITCQGDSLRSYYASWYQQKPGQAPVLVIYG KNNRPSGIPDRFSGSSSGNTASLTITGAQAEDEADYYCN SRDSSGNHVVFGCGTKLTVLGQGGGGSGGGGSGGGGSGG GGSEVQLVQSGGGVERPGGSLRLSCAASGFTFDDYGMSW VRQAPGKCLEWVSGINWNGGSTGYADSVKGRVTISRDNA KNSLYLQMNSLRAEDTAVYYCAKILGAGRGWYFDLWGKG TTVTVSS |
| SEQ ID NO: 158 | CDH17v1/TR2v1- (scFv VL-VH ss) LC | DIVMSQSPSSLAVSVGEKVTMSCKSSQSLLHSSNQKNYL AWYQQKPGQSPKVLIYWASTRESGVPDRFTGSGSGTDFT LTITSVKSEDLAVYYCQQYYSYPWTFGGGTRLEIKRTVA APSVFIFPPSDEQLKSGTASVVCLLNNFYPREAKVQWKV DNALQSGNSQESVTEQDSKDSTYSLSSTLTLSKADYEKH KVYACEVTHQGLSSPVTKSFNRGEC |
| SEQ ID NO: 159 | CDH17E9/TR2#1 (IgG1 KO) HC | QVQLQQSDAELVKPGASVKISCKVSGYTLTDHTIHWMKQ RPDQGLDWIGYIYPRDDITQYNENFKAKSTLTADKSSST AYMQLNSLTSEDSAVYFCARWSWHFGSNYYGLDYWGQGT SVTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP |

TABLE 3-continued

Amino acid sequences and SEQ ID NOs of CDRs, VH, VL, scFv, light and heavy chains of the binding molecules and antibodies of the invention.

| SEQ ID Number | Brief description of sequence | Sequence |
|---|---|---|
| | | CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSDIVMTQSHKF MSTSVGDRVSITCKASQDVITAVAWYQQKPGQSPKLLIY WASTRHTGVPDRFTGTGSGTDYTLTISSVQAEDLALYYC QQHYSTPWTFGGGTKLEIKGGGGSGGGGSGGGGSGGGGS QVQLQQSGAELVKPGASVKLSCKAFDYTFTSYDINWVKQ RPGQGLEWIGWIDPGSGNTKYNEKFKGKATLTADKSSST AYMHLSSLTSEDSAVYFCARKNYGGSYAFTYWGQGTLVT VA |
| SEQ ID NO: 160 | CDH17E9/TR2#2 (IgG1 KO) HC | QVQLQQSDAELVKPGASVKISCKVSGYTLTDHTIHWMKQ RPDQGLDWIGYIYPRDDITQYNENFKAKSTLTADKSSST AYMQLNSLTSEDSAVYFCARWSWHFGSNYYGLDYWGQGT SVTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSDIVMTQSHKF MSTSVGDRVSITCKASQDVSTAVAWYQQKPGQSPKVLIY WASTRHTGVPDRFTGSGSGTDYILTISSVQAEDLALYYC QQHYSTPYTFGGGTKLEIKGGGGSGGGGSGGGGSGGGGS KVQLQQSGAELVKTGTSVKLSCKASGYTFTEYIIHWVKQ RSGQGLEWIGWFYPGSGSIKYNEKFKDKATLTADKSSST VYMELSRLTSEDSAVYFCARHEEGGYSAWFPYWGQGTLV TVSA |
| SEQ ID NO: 161 | CDH17E9/TR2#3 (IgG1 KO) HC | QVQLQQSDAELVKPGASVKISCKVSGYTLTDHTIHWMKQ RPDQGLDWIGYIYPRDDITQYNENFKAKSTLTADKSSST AYMQLNSLTSEDSAVYFCARWSWHFGSNYYGLDYWGQGT SVTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSDVLMTQTPLS LPVSLGDQASISCRSSQSIVHSNGDTYLDWYLQKPGQSP KLLIYKVSNRFSGVPDRFSGSGSGTDFTLKISRVVAEDL GVYYCFRGSHIPPTFGAGTKLEKGGGGSGGGGSGGGGSG GGGSEVQLQQSGPELVKPGASVKISCKASGYTFTDYYYL NWVKQSHGKSLEWIGYIYPNNGDTSYNQKFKGKTTLTVD KSSSTAYMEFRSLTSEDSAVYYCTRGSNWIWYFDVWGTG TTVTVSS |
| SEQ ID NO: 162 | CDH17E9/TR2#7 (IgG1 KO) HC | QVQLQQSDAELVKPGASVKISCKVSGYTLTDHTIHWMKQ RPDQGLDWIGYIYPRDDITQYNENFKAKSTLTADKSSST AYMQLNSLTSEDSAVYFCARWSWHFGSNYYGLDYWGQGT SVTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSSIVMTQTPKF LPVSAGDRVTMTCKASQNVGNNVAWYQQKPGQSPKLLIS YASNRYTGVPDRFTGSGSGTDFFTISSVQVEDLAVYFCQ QHYSSPLTFGAGTKLELGGGGSGGGGSGGGGSGGGGSQ VQLKQSGAELVKPGASVKISCKASGYSFTDYYINWVKQR PGQGLEWIGKIGPGSGNTYYNEKFEGKATLTADKSSSTA YMQLSSLTSEDSAVYFCASTGPFAYWGQGTLVTWSA |

TABLE 3-continued

Amino acid sequences and SEQ ID NOs of CDRs, VH, VL, scFv, light and heavy chains of the binding molecules and antibodies of the invention.

| SEQ ID Number | Brief description of sequence | Sequence |
|---|---|---|
| SEQ ID NO: 163 | CDH17E9/TR2#8 (IgG1 KO) HC | QVQLQQSDAELVKPGASVKISCKVSGYTLTDHTIHWMKQ RPDQGLDWIGYIYPRDDITQYNENFKAKSTLTADKSSST AYMQLNSLTSEDSAVYFCARWSWHFGSNYYGLDYWGQGT SVTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSDIVMTQSHKF MSTSVGDRVSITCKASQDVGTAVAWYQQKPGQSPKLLIY WASTRHTGVPDRFTGSGSGTDFTLTISNVQSEDLADYFC QQYSSYPYTFGGGTKLEIKGGGGSGGGGSGGGGSGGGGS QVTLKESGPGILQPSQTLSLTCSFSGFSLSTSGMGVSWI RQPSGKGLEWLAHIYWDDDKRYNPSLKSRLTISKDTSRN QVFLKITSVDTADTATYYCARRRLGPFAYWGQGTLVTVS A |
| SEQ ID NO: 164 | CDH17E9/TR2#10 (IgG1 KO) HC | QVQLQQSDAELVKPGASVKISCKVSGYTLTDHTIHWMKQ RPDQGLDWIGYIYPRDDITQYNENFKAKSTLTADKSSST AYMQLNSLTSEDSAVYFCARWSWHFGSNYYGLDYWGQGT SVTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSDVLMTQTPLS LPVSLGDQASISCRSSQNIVHSNGNTYLDWYLQKPGQSP KLLIYKVSNRFSGVPDRFSGSGSGTDFTLKISRVEAEDL GVYYCFQGSHVPPTFGAGTKLELKGGGGSGGGGSGGGGS GGGGSEVQLQQSGPELVKPGASVKISCKASGYTFTDYYY MNWVKQSHGKSLEWIGYIYPNNGGTRYNQFKGKATLTV DKSSSTAYMELRSLTSEDSAVYYCARGGNWNWYFDVWGT GTTVTVSS |
| SEQ ID NO: 165 | CDH17E9/TR2#12 (IgG1 KO) HC | QVQLQQSDAELVKPGASVKISCKVSGYTLTDHTIHWMKQ RPDQGLDWIGYIYPRDDITQYNENFKAKSTLTADKSSST AYMQLNSLTSEDSAVYFCARWSWHFGSNYYGLDYWGQGT SVTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSDIVMTQSHKF MSTSVGDRVSITCKASQDVSNAVAWYQQKPGQSPKLLIY WASTRHNGVPDRFTGSGSGTDYILTISSVQAEDLALYYC QQHYRTPYTFGGGTKLEIKGGGGSGGGGSGGGGSGGGGS KVQLQQSGAELVKPGASVKLSCKASGYTFTEYIIHWVKQ KSGQGLEWIGWFYPGSGNIKYNEKFKDKATLTADKSSST VYMELSRLTSEDSAVYFCTRHEGGSNFPPYWGQGTLVTV SA |
| SEQ ID NO: 166 | CDH17E9/TR2v1 (IgG1 KO) HC | QVQLQQSDAELVKPGASVKISCKVSGYTLTDHTIHWMKQ RPDQGLDWIGYIYPRDDITQYNENFKAKSTLTADKSSST AYMQLNSLTSEDSAVYFCARWSWHFGSNYYGLDYWGQGT SVTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSDIELTQDPAV SVALGQTVRITCQGDSLRSYYASWYQQKPGQAPVLVIYG KNNRPSGIPDRFSGSSSGNTASLTITGAQAEDEADYYCN |

TABLE 3-continued

Amino acid sequences and SEQ ID NOs of CDRs, VH, VL, scFv, light and heavy chains of the binding molecules and antibodies of the invention.

| SEQ ID Number | Brief description of sequence | Sequence |
|---|---|---|
| | | SRDSSGNHVVFGCGTKLTVLGGGGSGGGGSGGGGSGGGG SEVQLVQSGGGVERPGGSLRLSCAASGFTFDDYGMSWVR QAPGKCLEWVSGINWNGGSTGYADSVKGRVTISRDNAKN SLYLQMNSLRAEDTAVYYCAKILGAGRGWYFDLWGKGTT VTVSS |
| SEQ ID NO: 167 | CDH17E9/TR2v2 (IgG1 KO) HC | QVQLQQSDAELVKPGASVKISCKVSGYTLTDHTIHWMKQ RPDQGLDWIGYIYPRDDITQYNENFKAKSTLTADKSSST AYMQLNSLTSEDSAVYFCARWSWHFGSNYYGLDYWGQGT SVTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSSSELTQDPAV SVALGQTVRITCQGDSLRSYYASWYQQKPGQAPVLVIYG KNNRPSGIPDRFSGSSSGNTASLTITGAQAEDEADYYCN SRDSSGNHVVFGGGTKLTVLGGGGSGGGGSGGGGSGGGG SEVQLVQSGGGVERPGGSLRLSCAASGFTFDDYGMSWVR QAPGKGLEWVSGINWNGGSTGYADSVKGRVTISRDNAKN SLYLQMNSLRAEDTAVYYCAKILGAGRGWYFDLWGKGTT VTVSS |
| SEQ ID NO: 168 | CDH17E9/TR2v3 (IgG1 KO) HC | QVQLQQSDAELVKPGASVKISCKVSGYTLTDHTIHWMKQ RPDQGLDWIGYIYPRDDITQYNENFKAKSTLTADKSSST AYMQLNSLTSEDSAVYFCARWSWHFGSNYYGLDYWGQGT SVTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSSSELTQDPAV SVALGQTVRITCQGDSLRSYYASWYQQKPGQAPVLVIYG KTNRPSGIPDRFSGSSSGNTASLTITGAQAEDEADYYCN SRDSSGTHVVFGGGTKLTVLGGGGSGGGGSGGGGSGGGG SEVQLVQSGGGVERPGGSLRLSCAASGFTFDDYGMSWVR QAPGKGLEWVSGINWSGGSTGYADSVKGRVTISRDNAKN SLYLQMNSLRAEDTAVYYCAKILGAGRGWYFDLWGKGTT VTVSS |
| SEQ ID NO: 169 | CDH17E9/TR2v4 (IgG1 KO) HC | QVQLQQSDAELVKPGASVKISCKVSGYTLTDHTIHWMKQ RPDQGLDWIGYIYPRDDITQYNENFKAKSTLTADKSSST AYMQLNSLTSEDSAVYFCARWSWHFGSNYYGLDYWGQGT SVTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSSSELTQDPAV SVALGQTVRITCQGDSLRSYYASWYQQKPGQAPVLVIYG KANRPSGIPDRFSGSSSGNTASLTITGAQAEDEADYYCN SRDSSGAHVVFGGGTKLTVLGGGGSGGGGSGGGGSGGGG SEVQLVQSGGGVERPGGSLRLSCAASGFTFDDYGMSWVR QAPGKGLEWVSGINWSGGSTGYADSVKGRVTISRDNAKN SLYLQMNSLRAEDTAVYYCAKILGAGRGWYFDLWGKGTT VTVSS |
| SEQ ID NO: 170 | CDH17E9/TR2v5 (IgG1 KO) HC | QVQLQQSDAELVKPGASVKISCKVSGYTLTDHTIHWMKQ RPDQGLDWIGYIYPRDDITQYNENFKAKSTLTADKSSST AYMQLNSLTSEDSAVYFCARWSWHFGSNYYGLDYWGQGT SVTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL |

TABLE 3-continued

Amino acid sequences and SEQ ID NOs of CDRs, VH, VL, scFv, light and heavy chains of the binding molecules and antibodies of the invention.

| SEQ ID Number | Brief description of sequence | Sequence |
|---|---|---|
| | | TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSSSELTQDPAV SVALGQTVRITCQGDSLRSYYASWYQQKPGQAPVLVIYG KNNRPSGIPDRFSGSSSGNTASLTITGAQAEDEADYYCN SRDSSGNHVVFGGGTKLTVLGGGSGGGGSGGGGSGGGG SEVQLVQSGGGVERPGGSLRLSCAASGFTFDDYGMSWVR QAPGKGLEWVSGINWSGGSTGYADSVKGRVTISRDNAKN SLYLQMNSLRAEDTAVYYCAKILGAGRGWYFDLWGKGTT VTVSS |
| SEQ ID NO: 171 | CDH17E9/TR2v6 (IgG1 KO) HC | QVQLQQSDAELVKPGASVKISCKVSGYTLTDHTIHWMKQ RPDQGLDWIGYIYPRDDITQYNENFKAKSTLTADKSSST AYMQLNSLTSEDSAVYFCARWSWHFGSNYYGLDYWGQGT SVTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSSSELTQDPAV SVALGQTVRITCQGDSLRSYYASWYQQKPGQAPVLVIYG KTNRPSGIPDRFSGSSSGNTASLTITGAQAEDEADYYCN SRDSSGDHVVFGGGTKLTVLGGGSGGGGSGGGGSGGGG SEVQLVQSGGGVERPGGSLRLSCAASGFTFDDYGMSWVR QAPGKGLEWVSGINWAGGSTGYADSVKGRVTISRDNAKN SLYLQMNSLRAEDTAVYYCAKILGAGRGWYFDLWGKGTT VTVSS |
| SEQ ID NO: 172 | CDH17E9/TR2v7 (IgG1 KO) HC | QVQLQQSDAELVKPGASVKISCKVSGYTLTDHTIHWMKQ RPDQGLDWIGYIYPRDDITQYNENFKAKSTLTADKSSST AYMQLNSLTSEDSAVYFCARWSWHFGSNYYGLDYWGQGT SVTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSSSELTQDPAV SVALGQTVRITCQGDSLRSYYASWYQQKPGQAPVLVIYG KDNRPSGIPDRFSGSSSGNTASLTITGAQAEDEADYYCN SRDSSGDHVVFGGGTKLTVLGGGSGGGGSGGGGSGGGG SEVQLVQSGGGVERPGGSLRLSCAASGFTFDDYGMSWVR QAPGKGLEWVSGINWTGGSTGYADSVKGRVTISRDNAKN SLYLQMNSLRAEDTAVYYCAKILGAGRGWYFDLWGKGTT VTVSS |
| SEQ ID NO: 173 | CDH17E9 LC | DIVMTQSQTFMSTTVGDRVSITCKASQNVGTALAWYQQK PRQSPKLLIYSASNRFTGVPDRFTGSGSGTDFTLTISNM RSEDLADYVCQQYSTYPLTFGSGTKLEIRRTVAAPSVFI FPPSDEQLKSGTASVVCLLNNFYPREAKVQWKVDNALQS GNSQESVFEQDSKDSTYSLSSTLTLSKADYEKHKVYACE VTHQGLSSPVTKSFNRGEC |
| SEQ ID NO: 174 | CDH17A6/TR2#1 (IgG1 KO) HC | QVQLQQSDAELVKPGASVKISCKVSGYTFTDHTIHWMKQ RPEQGLEWIGYIYPRDAITKYNEKFKGKATLTADKSSST AYMQLNSLTSEDSAVYFCARWGYYFGSTSYYFDFVVGQG TTLTVSSASTKGPSVFPLAPSSKSTSGGTAALGCLVKDY FPEPVTVSWNSGALTSGVHTFPAVLQSSGLYSLSSVVTV PSSSLGTQTYICNVNHKPSNTKVDKRVEPKSCDKTHTCP PCPAPEAAGGPSVFLFPPKPKDTLMISRTPEVTCVVVDV SHEDPEVKFNWYVDGVEVHNAKTKPREEQYNSTYRVVSV LTVLHQDWLNGKEYKCKVSNKALPAPIEKTISKAKGQPR EPQVYTLPPSREEMTKNQVSLTCLVKGFYPSDIAVEWES NGQPENNYKTTPPVLDSDGSFFLYSKLTVDKSRWQQGNV FSCSVMHEALHNHYTQKSLSLSPGGGSGGSDIVMTQSHK FMSTSVGDRVSITCKASQDVITAVAWYQQKPGQSPKLLI YWASTRHTGVPDRFTGTGSGTDYTLTISSVQAEDLALYY CQQHYSTPWTFGGGTKLEIKGGGGSGGGGSGGGGSGGGG |

TABLE 3-continued

Amino acid sequences and SEQ ID NOs of CDRs, VH, VL, scFv, light and heavy chains of the binding molecules and antibodies of the invention.

| SEQ ID Number | Brief description of sequence | Sequence |
|---|---|---|
| | | SQVQLQQSGAELVKPGASVKLSCKAFDYTFTSYDINWVK QRPGQGLEWIGWIDPGSGNTKYNEKFKGKATLTADKSSS TAYMHLSSLTSEDSAVYFCARKNYGGSYAFTYWGQGTLV TVA |
| SEQ ID NO: 175 | CDH17A6/TR2#2 (IgG1 KO) HC | QVQLQQSDAELVKPGASVKISCKVSGYTFTDHTIHWMKQ RPEQGLEWIGYIYPRDAITKYNEKFKGKATLTADKSSST AYMQLNSLTSEDSAVYFCARWGYYFGSTSYYFDPVVGQG TTLTVSSASTKGPSVFPLAPSSKSTSGGTAALGCLVKDY FPEPVTVSWNSGALTSGVHTFPAVLQSSGLYSLSSVVTV PSSSLGTQTYICNVNHKPSNTKVDKRVEPKSCDKTHTCP PCPAPEAAGGPSVFLFPPKPKDTLMISRTPEVTCVVVDV SHEDPEVKFNWYVDGVEVHNAKTKPREEQYNSTYRVVSV LTVLHQDWLNGKEYKCKVSNKALPAPIEKTISKAKGQPR EPQVYTLPPSREEMTKNQVSLTCLVKGFYPSDIAVEWES NGQPENNYKTTPPVLDSDGSFFLYSKLTVDKSRWQQGNV FSCSVMHEALHNHYTQKSLSLSPGGGSGGSDIVMTQSHK FMSTSVGDRVSITCKASQDVSTAVAWYQQKPGQSPKVLI YWASTRHTGVPDRFTGSGSGTDYILTISSVQAEDLALYY CQQHYSTPYTFGGGTKLEIKGGGGSGGGGSGGGGSGGGG SKVQLQQSGAELVKTGTSVKLSCKASGYTFTEYIIHWVK QRSGQGLEWIGWFYPGSGSIKYNEKFKDKATLTADKSSS TVYMELSRLTSEDSAVYFCARHEEGGYSAWFPYWGQGTL VTVSA |
| SEQ ID NO: 176 | CDH17A6/TR2#3 (IgG1 KO) HC | QVQLQQSDAELVKPGASVKISCKVSGYTFTDHTIHWMKQ RPEQGLEWIGYIYPRDAITKYNEKFKGKATLTADKSSST AYMQLNSLTSEDSAVYFCARWGYYFGSTSYYFDPVVGQG TTLTVSSASTKGPSVFPLAPSSKSTSGGTAALGCLVKDY FPEPVTVSWNSGALTSGVHTFPAVLQSSGLYSLSSVVTV PSSSLGTQTYICNVNHKPSNTKVDKRVEPKSCDKTHTCP PCPAPEAAGGPSVFLFPPKPKDTLMISRTPEVTCVVVDV SHEDPEVKFNWYVDGVEVHNAKTKPREEQYNSTYRVVSV LTVLHQDWLNGKEYKCKVSNKALPAPIEKTISKAKGQPR EPQVYTLPPSREEMTKNQVSLTCLVKGFYPSDIAVEWES NGQPENNYKTTPPVLDSDGSFFLYSKLTVDKSRWQQGNV FSCSVMHEALHNHYTQKSLSLSPGGGSGGSDVLMTQTPL SLPVSLGDQASISCRSSQSIVHSNGDTYLDWYLQKPGQS PKLLIYKVSNRFSGVPDRFSGSGSGTDFTLKISRVVAED LGVYYCFRGSHIPPTFGAGTKLEKGGGGSGGGGSGGGGS GGGGSEVQLQQSGPELVKPGASVKISCKASGYTFTDYYY LNWVKQSHGKSLEWIGYIYPNNGDTSYNQKFKGKTTLTV DKSSSTAYMEFRSLTSEDSAVYYCTRGSNWIWYFDVWGT GTTVTVSS |
| SEQ ID NO: 177 | CDH17A6/TR2#7 (IgG1 KO) HC | QVQLQQSDAELVKPGASVKISCKVSGYTFTDHTIHWMKQ RPEQGLEWIGYIYPRDAITKYNEKFKGKATLTADKSSST AYMQLNSLTSEDSAVYFCARWGYYFGSTSYYFDPVVGQG TTLTVSSASTKGPSVFPLAPSSKSTSGGTAALGCLVKDY FPEPVTVSWNSGALTSGVHTFPAVLQSSGLYSLSSVVTV PSSSLGTQTYICNVNHKPSNTKVDKRVEPKSCDKTHTCP PCPAPEAAGGPSVFLFPPKPKDTLMISRTPEVTCVVVDV SHEDPEVKFNWYVDGVEVHNAKTKPREEQYNSTYRVVSV LTVLHQDWLNGKEYKCKVSNKALPAPIEKTISKAKGQPR EPQVYTLPPSREEMTKNQVSLTCLVKGFYPSDIAVEWES NGQPENNYKTTPPVLDSDGSFFLYSKLTVDKSRWQQGNV FSCSVMHEALHNHYTQKSLSLSPGGGSGGSSIVMTQTPK FLPVSAGDRVTMTCKASQNVGNNVAWYQQKPGQSPKLLI SYASNRYTGVPDRFTGSGSGTDFFTISSVQVEDLAVYFC QQHYSSPLTFGAGTKLELKGGGGSGGGGSGGGGSGGGGS QVQLKQSGAELVKPGASVKISCKASGYSFTDYYINWVKQ RPGQGLEWIGKIGPGSGNTYYNEKFEGKATLTADKSSST AYMQLSSLTSEDSAVYFCASTGPFAYWGQGTLVTWSA |
| SEQ ID NO: 178 | CDH17A6/TR2#8 (IgG1 KO) HC | QVQLQQSDAELVKPGASVKISCKVSGYTFTDHTIHWMKQ RPEQGLEWIGYIYPRDAITKYNEKFKGKATLTADKSSST AYMQLNSLTSEDSAVYFCARWGYYFGSTSYYFDPVVGQG TTLTVSSASTKGPSVFPLAPSSKSTSGGTAALGCLVKDY FPEPVTVSWNSGALTSGVHTFPAVLQSSGLYSLSSVVTV PSSSLGTQTYICNVNHKPSNTKVDKRVEPKSCDKTHTCP PCPAPEAAGGPSVFLFPPKPKDTLMISRTPEVTCVVVDV SHEDPEVKFNWYVDGVEVHNAKTKPREEQYNSTYRVVSV LTVLHQDWLNGKEYKCKVSNKALPAPIEKTISKAKGQPR EPQVYTLPPSREEMTKNQVSLTCLVKGFYPSDIAVEWES |

TABLE 3-continued

Amino acid sequences and SEQ ID NOs of CDRs, VH, VL, scFv, light and heavy chains of the binding molecules and antibodies of the invention.

| SEQ ID Number | Brief description of sequence | Sequence |
| --- | --- | --- |
| | | NGQPENNYKTTPPVLDSDGSFFLYSKLTVDKSRWQQGNV<br>FSCSVMHEALHNHYTQKSLSLSPGGGSGGSDIVMTQSHK<br>FMSTSVGDRVSITCKASQDVGTAVAWYQQKPGQSPKLLI<br>YWASTRHTGVPDRFTGSGSGTDFTLTISNVQSEDLADYF<br>CQQYSSYPYTFGGGTKLEIKGGGGSGGGGSGGGGSGGGG<br>SQVTLKESGPGILQPSQTLSLTCSFSGFSLSTSGMGVSW<br>IRQPSGKGLEWLAHIYWDDDKRYNPSLKSRLTISKDTSR<br>NQVFLKITSVDTADTATYYCARRRLGPFAYWGQGTLVTV<br>SA |
| SEQ ID NO: 179 | CDH17A6/TR2#10 (IgG1 KO) HC | QVQLQQSDAELVKPGASVKISCKVSGYTFTDHTIHWMKQ<br>RPEQGLEWIGYIYPRDAITKYNEKFKGKATLTADKSSST<br>AYMQLNSLTSEDSAVYFCARWGYYFGSTSYYFDFVVGQG<br>TTLTVSSASTKGPSVFPLAPSSKSTSGGTAALGCLVKDY<br>FPEPVTVSWNSGALTSGVHTFPAVLQSSGLYSLSSVVTV<br>PSSSLGTQTYICNVNHKPSNTKVDKRVEPKSCDKTHTCP<br>PCPAPEAAGGPSVFLFPPKPKDTLMISRTPEVTCVVVDV<br>SHEDPEVKFNWYVDGVEVHNAKTKPREEQYNSTYRVVSV<br>LTVLHQDWLNGKEYKCKVSNKALPAPIEKTISKAKGQPR<br>EPQVYTLPPSREEMTKNQVSLTCLVKGFYPSDIAVEWES<br>NGQPENNYKTTPPVLDSDGSFFLYSKLTVDKSRWQQGNV<br>FSCSVMHEALHNHYTQKSLSLSPGGSGGSDVLMTQTPL<br>SLPVSLGDQASISCRSSQNIVHSNGNTYLDWYLQKPGQS<br>PKLLIYKVSNRFSGVPDRFSGSGSGTDFTLKISRVEAED<br>LGVYYCFQGSHVPPTFGAGTKLELKGGGGSGGGGSGGGG<br>SGGGGSEVQLQQSGPELVKPGASVKISCKASGYTFTDYY<br>YMNWVKQSHGKSLEWIGYIYPNNGGTRYNQKFKGKATLT<br>VDKSSSTAYMELRSLTSEDSAVYYCARGGNWNWYFDVWG<br>TGTTVTVSS |
| SEQ ID NO: 180 | CDH17A6/TR2#12 (IgG1 KO) HC | QVQLQQSDAELVKPGASVKISCKVSGYTFTDHTIHWMKQ<br>RPEQGLEWIGYIYPRDAITKYNEKFKGKATLTADKSSST<br>AYMQLNSLTSEDSAVYFCARWGYYFGSTSYYFDFVVGQG<br>TTLTVSSASTKGPSVFPLAPSSKSTSGGTAALGCLVKDY<br>FPEPVTVSWNSGALTSGVHTFPAVLQSSGLYSLSSVVTV<br>PSSSLGTQTYICNVNHKPSNTKVDKRVEPKSCDKTHTCP<br>PCPAPEAAGGPSVFLFPPKPKDTLMISRTPEVTCVVVDV<br>SHEDPEVKFNWYVDGVEVHNAKTKPREEQYNSTYRVVSV<br>LTVLHQDWLNGKEYKCKVSNKALPAPIEKTISKAKGQPR<br>EPQVYTLPPSREEMTKNQVSLTCLVKGFYPSDIAVEWES<br>NGQPENNYKTTPPVLDSDGSFFLYSKLTVDKSRWQQGNV<br>FSCSVMHEALHNHYTQKSLSLSPGGGSGGSDIVMTQSHK<br>FMSTSVGDRVSITCKASQDVSNAVAWYQQKPGQSPKLLI<br>YWASTRHNGVPDRFTGSGSGTDYILTISSVQAEDLALYY<br>CQQHYRTPYTFGGGTKLEIKGGGGSGGGGSGGGGSGGGG<br>SKVQLQQSGAELVKPGASVKLSCKASGYTFFEYIIHWVK<br>QKSGQGLEWIGWFYPGSGNIKYNEKFKDKATLTADKSSS<br>TVYMELSRLTSEDSAVYFCTRHEGGSNFFPYWGQGTLVT<br>VSA |
| SEQ ID NO: 181 | CDH17A6/TR2v1 (IgG1 KO) HC | QVQLQQSDAELVKPGASVKISCKVSGYTFTDHTIHWMKQ<br>RPEQGLEWIGYIYPRDAITKYNEKFKGKATLTADKSSST<br>AYMQLNSLTSEDSAVYFCARWGYYFGSTSYYFDFVVGQG<br>TTLTVSSASTKGPSVFPLAPSSKSTSGGTAALGCLVKDY<br>FPEPVTVSWNSGALTSGVHTFPAVLQSSGLYSLSSVVTV<br>PSSSLGTQTYICNVNHKPSNTKVDKRVEPKSCDKTHTCP<br>PCPAPEAAGGPSVFLFPPKPKDTLMISRTPEVTCVVVDV<br>SHEDPEVKFNWYVDGVEVHNAKTKPREEQYNSTYRVVSV<br>LTVLHQDWLNGKEYKCKVSNKALPAPIEKTISKAKGQPR<br>EPQVYTLPPSREEMTKNQVSLTCLVKGFYPSDIAVEWES<br>NGQPENNYKTTPPVLDSDGSFFLYSKLTVDKSRWQQGNV<br>FSCSVMHEALHNHYTQKSLSLSPGGSGGSDIELTQDPA<br>VSVALGQTVRITCQGDSLRSYYASWYQQKPGQAPVLVIY<br>GKNNRPSGIPDRFSGSSSGNTASLTITGAQAEDEADYYC<br>NSRDSSGNHVVFGCGTKLTVLGGGGSGGGGSGGGGSGGG<br>GSEVQLVQSGGGVERPGGSLRLSCAASGFTFDDYGMSWV<br>RQAPGKCLEWVSGINWNGGSTGYADSVKGRVTISRDNAK<br>NSLYLQMNSLRAEDTAVYYCAKILGAGRGWYFDLWGKGT<br>TVTVSS |
| SEQ ID NO: 182 | CDH17A6/TR2v2 (IgG1 KO) HC | QVQLQQSDAELVKPGASVKISCKVSGYTFTDHTIHWMKQ<br>RPEQGLEWIGYIYPRDAITKYNEKFKGKATLTADKSSST<br>AYMQLNSLTSEDSAVYFCARWGYYFGSTSYYFDFVVGQG<br>TTLTVSSASTKGPSVFPLAPSSKSTSGGTAALGCLVKDY |

TABLE 3-continued

Amino acid sequences and SEQ ID NOs of CDRs, VH, VL, scFv, light and heavy chains of the binding molecules and antibodies of the invention.

| SEQ ID Number | Brief description of sequence | Sequence |
|---|---|---|
| | | FPEPVTVSWNSGALTSGVHTFPAVLQSSGLYSLSSVVTV<br>PSSSLGTQTYICNVNHKPSNTKVDKRVEPKSCDKTHTCP<br>PCPAPEAAGGPSVFLFPPKPKDTLMISRTPEVTCVVVDV<br>SHEDPEVKFNWYVDGVEVHNAKTKPREEQYNSTYRVVSV<br>LTVLHQDWLNGKEYKCKVSNKALPAPIEKTISKAKGQPR<br>EPQVYTLPPSREEMTKNQVSLTCLVKGFYPSDIAVEWES<br>NGQPENNYKTTPPVLDSDGSFFLYSKLTVDKSRWQQGNV<br>FSCSVMHEALHNHYTQKSLSLSPGGGSGGSSSELTQDPA<br>VSVALGQTVRITCQGDSLRSYYASWYQQKPGQAPVLVIY<br>GKNNRPSGIPDRFSGSSSGNTASLTITGAQAEDEADYYC<br>NSRDSSGNHVVFGGGTKLTVLGGGGSGGGGSGGGGSGGG<br>GSEVQLVQSGGGVERPGGSLRLSCAASGFTFDDYGMSWV<br>RQAPGKGLEWVSGINWNGGSTGYADSVKGRVTISRDNAK<br>NSLYLQMNSLRAEDTAVYYCAKILGAGRGWYFDLWGKGT<br>TVTVSS |
| SEQ ID NO: 183 | CDH17A6/TR2v3 (IgG1 KO) HC | QVQLQQSDAELVKPGASVKISCKVSGYTFTDHTIHWMKQ<br>RPEQGLEWIGYIYPRDAITKYNEKFKGKATLTADKSSST<br>AYMQLNSLTSEDSAVYFCARWGYYFGSTSYYFDFVVGQG<br>TTLTVSSASTKGPSVFPLAPSSKSTSGGTAALGCLVKDY<br>FPEPVTVSWNSGALTSGVHTFPAVLQSSGLYSLSSVVTV<br>PSSSLGTQTYICNVNHKPSNTKVDKRVEPKSCDKTHTCP<br>PCPAPEAAGGPSVFLFPPKPKDTLMISRTPEVTCVVVDV<br>SHEDPEVKFNWYVDGVEVHNAKTKPREEQYNSTYRVVSV<br>LTVLHQDWLNGKEYKCKVSNKALPAPIEKTISKAKGQPR<br>EPQVYTLPPSREEMTKNQVSLTCLVKGFYPSDIAVEWES<br>NGQPENNYKTTPPVLDSDGSFFLYSKLTVDKSRWQQGNV<br>FSCSVMHEALHNHYTQKSLSLSPGGGSGGSSSELTQDPA<br>VSVALGQTVRITCQGDSLRSYYASWYQQKPGQAPVLVIY<br>GKTNRPSGIPDRFSGSSSGNTASLTITGAQAEDEADYYC<br>NSRDSSGTHVVFGGGTKLTVLGGGGSGGGGSGGGGSGGG<br>GSEVQLVQSGGGVERPGGSLRLSCAASGFTFDDYGMSWV<br>RQAPGKGLEWVSGINWSGGSTGYADSVKGRVTISRDNAK<br>NSLYLQMNSLRAEDTAVYYCAKILGAGRGWYFDLWGKGT<br>TVTVSS |
| SEQ ID NO: 184 | CDH17A6/TR2v4 (IgG1 KO) HC | QVQLQQSDAELVKPGASVKISCKVSGYTFTDHTIHWMKQ<br>RPEQGLEWIGYIYPRDAITKYNEKFKGKATLTADKSSST<br>AYMQLNSLTSEDSAVYFCARWGYYFGSTSYYFDFVVGQG<br>TTLTVSSASTKGPSVFPLAPSSKSTSGGTAALGCLVKDY<br>FPEPVTVSWNSGALTSGVHTFPAVLQSSGLYSLSSVVTV<br>PSSSLGTQTYICNVNHKPSNTKVDKRVEPKSCDKTHTCP<br>PCPAPEAAGGPSVFLFPPKPKDTLMISRTPEVTCVVVDV<br>SHEDPEVKFNWYVDGVEVHNAKTKPREEQYNSTYRVVSV<br>LTVLHQDWLNGKEYKCKVSNKALPAPIEKTISKAKGQPR<br>EPQVYTLPPSREEMTKNQVSLTCLVKGFYPSDIAVEWES<br>NGQPENNYKTTPPVLDSDGSFFLYSKLTVDKSRWQQGNV<br>FSCSVMHEALHNHYTQKSLSLSPGGGSGGSSSELTQDPA<br>VSVALGQTVRITCQGDSLRSYYASWYQQKPGQAPVLVIY<br>GKANRPSGIPDRFSGSSSGNTASLTITGAQAEDEADYYC<br>NSRDSSGAHVVFGGGTKLTVLGGGGSGGGGSGGGGSGGG<br>GSEVQLVQSGGGVERPGGSLRLSCAASGFTFDDYGMSWV<br>RQAPGKGLEWVSGINWSGGSTGYADSVKGRVTISRDNAK<br>NSLYLQMNSLRAEDTAVYYCAKILGAGRGWYFDLWGKGT<br>TVTVSS |
| SEQ ID NO: 185 | CDH17A6/TR2v5 (IgG1 KO) HC | QVQLQQSDAELVKPGASVKISCKVSGYTFTDHTIHWMKQ<br>RPEQGLEWIGYIYPRDAITKYNEKFKGKATLTADKSSST<br>AYMQLNSLTSEDSAVYFCARWGYYFGSTSYYFDFVVGQG<br>TTLTVSSASTKGPSVFPLAPSSKSTSGGTAALGCLVKDY<br>FPEPVTVSWNSGALTSGVHTFPAVLQSSGLYSLSSVVTV<br>PSSSLGTQTYICNVNHKPSNTKVDKRVEPKSCDKTHTCP<br>PCPAPEAAGGPSVFLFPPKPKDTLMISRTPEVTCVVVDV<br>SHEDPEVKFNWYVDGVEVHNAKTKPREEQYNSTYRVVSV<br>LTVLHQDWLNGKEYKCKVSNKALPAPIEKTISKAKGQPR<br>EPQVYTLPPSREEMTKNQVSLTCLVKGFYPSDIAVEWES<br>NGQPENNYKTTPPVLDSDGSFFLYSKLTVDKSRWQQGNV<br>FSCSVMHEALHNHYTQKSLSLSPGGGSGGSSSELTQDPA<br>VSVALGQTVRITCQGDSLRSYYASWYQQKPGQAPVLVIY<br>GKNNRPSGIPDRFSGSSSGNTASLTITGAQAEDEADYYC<br>NSRDSSGNHVVFGGGTKLTVLGGGGSGGGGSGGGGSGGG<br>GSEVQLVQSGGGVERPGGSLRLSCAASGFTFDDYGMSWV |

TABLE 3-continued

Amino acid sequences and SEQ ID NOs of CDRs, VH, VL, scFv, light and heavy chains of the binding molecules and antibodies of the invention.

| SEQ ID Number | Brief description of sequence | Sequence |
|---|---|---|
| | | RQAPGKGLEWVSGINWSGGSTGYADSVKGRVTISRDNAK NSLYLQMNSLRAEDTAVYYCAKILGAGRGWYFDLWGKGT TVTVSS |
| SEQ ID NO: 186 | CDH17A6/TR2v6 (IgG1 KO) HC | QVQLQQSDAELVKPGASVKISCKVSGYTFTDHTIHWMKQ RPEQGLEWIGYIYPRDAITKYNEKFKGKATLTADKSSST AYMQLNSLTSEDSAVYFCARWGYYFGSTSYYFDFVVGQG TTLTVSSASTKGPSVFPLAPSSKSTSGGTAALGCLVKDY FPEPVTVSWNSGALTSGVHTFPAVLQSSGLYSLSSVVTV PSSSLGTQTYICNVNHKPSNTKVDKRVEPKSCDKTHTCP PCPAPEAAGGPSVFLFPPKPKDTLMISRTPEVTCVVVDV SHEDPEVKFNWYVDGVEVHNAKTKPREEQYNSTYRVVSV LTVLHQDWLNGKEYKCKVSNKALPAPIEKTISKAKGQPR EPQVYTLPPSREEMTKNQVSLTCLVKGFYPSDIAVEWES NGQPENNYKTTPPVLDSDGSFFLYSKLTVDKSRWQQGNV FSCSVMHEALHNHYTQKSLSLSPGGGSGGSSSELTQDPA VSVALGQTVRITCQGDSLRSYYASWYQQKPGQAPVLVIY GKTNRPSGIPDRFSGSSSGNTASLTITGAQAEDEADYYC NSRDSSGDHVVFGGGTKLTVLGGGGSGGGGSGGGGSGGG GSEVQLVQSGGGVERPGGSLRLSCAASGFTFDDYGMSWV RQAPGKGLEWVSGINWAGGSTGYADSVKGRVTISRDNAK NSLYLQMNSLRAEDTAVYYCAKILGAGRGWYFDLWGKGT TVTVSS |
| SEQ ID NO: 187 | CDH17A6/TR2v7 (IgG1 KO) HC | QVQLQQSDAELVKPGASVKISCKVSGYTFTDHTIHWMKQ RPEQGLEWIGYIYPRDAITKYNEKFKGKATLTADKSSST AYMQLNSLTSEDSAVYFCARWGYYFGSTSYYFDFVVGQG TTLTVSSASTKGPSVFPLAPSSKSTSGGTAALGCLVKDY FPEPVTVSWNSGALTSGVHTFPAVLQSSGLYSLSSVVTV PSSSLGTQTYICNVNHKPSNTKVDKRVEPKSCDKTHTCP PCPAPEAAGGPSVFLFPPKPKDTLMISRTPEVTCVVVDV SHEDPEVKFNWYVDGVEVHNAKTKPREEQYNSTYRVVSV LTVLHQDWLNGKEYKCKVSNKALPAPIEKTISKAKGQPR EPQVYTLPPSREEMTKNQVSLTCLVKGFYPSDIAVEWES NGQPENNYKTTPPVLDSDGSFFLYSKLTVDKSRWQQGNV FSCSVMHEALHNHYTQKSLSLSPGGGSGGSSSELTQDPA VSVALGQTVRITCQGDSLRSYYASWYQQKPGQAPVLVIY GKDNRPSGIPDRFSGSSSGNTASLTITGAQAEDEADYYC NSRDSSGDHVVFGGGTKLTVLGGGGSGGGGSGGGGSGGG GSEVQLVQSGGGVERPGGSLRLSCAASGFTFDDYGMSWV RQAPGKGLEWVSGINWTGGSTGYADSVKGRVTISRDNAK NSLYLQMNSLRAEDTAVYYCAKILGAGRGWYFDLWGKGT TVTVSS |
| SEQ ID NO: 188 | CDH17A6 LC | DIVMTQSQKFMSTTVGDRVSITCKASQNVGTGVVWYQQR PGQSPKWYSPSNRYTGVPDRFTGSGSGTDFTLTITNIQS EDLADYFCQQYSTYPWTFGGGTKLEIKRTVAAPSVFIFP PSDEQLKSGTASVVCLLNNFYPREAKVQWKVDNALQSGN SQESVTEQDSKDSTYSLSSTLTLSKADYEKHKVYACEVT HQGLSSPVTKSFNRGEC |
| SEQ ID NO: 189 | CDH17E2/TR2#1 (IgG1 KO) HC | QVQLQQSDAELVKPGASVKISCKVSGYTFTDHTIHWMKQ RPEQGLEWIGYIYPRDVITQYNEKFKGKATLTADKSSST AYMQLNSLTSEDSAVYLCARWGYFYGSRSYYFDYWGQGT TLTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSDIVMTQSHKF MSTSVGDRVSITCKASQDVITAVAWYQQKPGQSPKLLIY WASTRHTGVPDRFTGTGSGTDYTLTISSVQAEDLALYYC QQHYSTPWTFGGGTKLEIKGGGGSGGGGSGGGGSGGGGS QVQLQQSGAELVKPGASVKLSCKAFDYTFTSYDINWVKQ RPGQGLEWIGWIDPGSGNTKYNEKFKGKATLTADKSSST AYMHLSSLTSEDSAVYFCARKNYGGSYAFTYWGQGTLVT VA |
| SEQ ID NO: 190 | CDH17E2/TR2#2 (IgG1 KO) HC | QVQLQQSDAELVKPGASVKISCKVSGYTFTDHTIHWMKQ RPEQGLEWIGYIYPRDVITQYNEKFKGKATLTADKSSST AYMQLNSLTSEDSAVYLCARWGYFYGSRSYYFDYWGQGT |

TABLE 3-continued

Amino acid sequences and SEQ ID NOs of CDRs, VH, VL, scFv, light and heavy chains of the binding molecules and antibodies of the invention.

| SEQ ID Number | Brief description of sequence | Sequence |
|---|---|---|
| | | TLTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGGSDIVMTQSHKF MSTSVGDRVSITCKASQDVSTAVAWYQQKPGQSPKVLIY WASTRHTGVPDRFTGSGSGTDYILTISSVQAEDLALYYC QQHYSTPYTFGGGTKLEIKGGGGSGGGGSGGGGSGGGGS KVQLQQSGAELVKTGTSVKLSCKASGYTFTEYIIHWVKQ RSGQGLEWIGWFYPGSGSIKYNEKFKDKATLTADKSSST VYMELSRLTSEDSAVYFCARHEEGGYSAWFPYWGQGTLV TVSA |
| SEQ ID NO: 191 | CDH17E2/TR2#3 (IgG1 KO) HC | QVQLQQSDAELVKPGASVKISCKVSGYTFTDHTIHWMKQ RPEQGLEWIGYIYPRDVITQYNEKFKGKATLTADKSSST AYMQLNSLTSEDSAVYLCARWGYFYGSRSYYFDYWGQGT TLTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGGSDVLMTQTPLS LPVSLGDQASISCRSSQSIVHSNGDTYLDWYLQKPGQSP KLLIYKVSNRFSGVPDRFSGSGSGTDFTLKISRVVAEDL GVYYCFRGSHIPPTFGAGTKLEKGGGGSGGGGSGGGGSG GGGSEVQLQQSGPELVKPGASVKISCKASGYTFTDYYYL NWVKQSHGKSLEWIGYIYPNNGDTSYNQKFKGKTTLTVD KSSSTAYMEFRSLTSEDSAVYYCTRGSNWIWYFDVWGTG TTVTVSS |
| SEQ ID NO: 192 | CDH17E2/TR2#7 (IgG1 KO) HC | QVQLQQSDAELVKPGASVKISCKVSGYTFTDHTIHWMKQ RPEQGLEWIGYIYPRDVITQYNEKFKGKATLTADKSSST AYMQLNSLTSEDSAVYLCARWGYFYGSRSYYFDYWGQGT TLTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGGSSIVMTQTPKF LPVSAGDRVTMTCKASQNVGNNVAWYQQKPGQSPKLLIS YASNRYTGVPDRFTGSGSGTDFFTISSVQVEDLAVYFCQ QHYSSPLTFGAGTKLELKGGGGSGGGGSGGGGSGGGGSQ VQLKQSGAELVKPGASVKISCKASGYSFTDYYINWVKQR PGQGLEWIGKIGPGSGNTYYNEKIAEGKATLTADKSSST AYMQLSSLTSEDSAVYFCASTGPFAYWGQGTLVTWSA |
| SEQ ID NO: 193 | CDH17E2/TR2#8 (IgG1 KO) HC | QVQLQQSDAELVKPGASVKISCKVSGYTFTDHTIHWMKQ RPEQGLEWIGYIYPRDVITQYNEKFKGKATLTADKSSST AYMQLNSLTSEDSAVYLCARWGYFYGSRSYYFDYWGQGT TLTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGGSDIVMTQSHKF MSTSVGDRVSITCKASQDVGTAVAWYQQKPGQSPKLLIY WASTRHTGVPDRFTGSGSGTDFTLTISNVQSEDLADYFC QQYSSYPYTFGGGTKLEIKGGGGSGGGGSGGGGSGGGGS QVTLKESGPGILQPSQTLSLTCSFSGFSLSTSGMGVSWI |

TABLE 3-continued

Amino acid sequences and SEQ ID NOs of CDRs, VH, VL, scFv, light and heavy chains of the binding molecules and antibodies of the invention.

| SEQ ID Number | Brief description of sequence | Sequence |
|---|---|---|
| | | RQPSGKGLEWLAHIYWDDDKRYNPSLKSRLTISKDTSRN QVFLKITSVDTADTATYYCARRRLGPFAYWGQGTLVTVS A |
| SEQ ID NO: 194 | CDH17E2/TR2#10 (IgG1 KO) HC | QVQLQQSDAELVKPGASVKISCKVSGYTFTDHTIHWMKQ RPEQGLEWIGYIYPRDVITQYNEKFKGKATLTADKSSST AYMQLNSLTSEDSAVYLCARWGYFYGSRSYYFDYWGQGT TLTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSDVLMTQTPLS LPVSLGDQASISCRSSQNIVHSNGNTYLDWYLQKPGQSP KLLIYKVSNRFSGVPDRFSGSGSGTDFTLKISRVEAEDL GVYYCFQGSHVPPTFGAGTKLELKGGGGSGGGGSGGGGS GGGGSEVQLQQSGPELVKPGASVKISCKASGYTFTDYYY MNWVKQSHGKSLEWIGYIYPNNGGTRYNQKFKGKATLTV DKSSSTAYMELRSLTSEDSAVYYCARGGNWNWYFDVWGT GTTVTVSS |
| SEQ ID NO: 195 | CDH17E2/TR2#12 (IgG1 KO) HC | QVQLQQSDAELVKPGASVKISCKVSGYTFTDHTIHWMKQ RPEQGLEWIGYIYPRDVITQYNEKFKGKATLTADKSSST AYMQLNSLTSEDSAVYLCARWGYFYGSRSYYFDYWGQGT TLTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSDIVMTQSHKF MSTSVGDRVSITCKASQDVSNAVAWYQQKPGQSPKLLIY WASTRHNGVPDRFTGSGSGTDYILTISSVQAEDLALYYC QQHYRTPYTFGGGTKLEIKGGGGSGGGGSGGGGSGGGGS KVQLQQSGAELVKPGASVKLSCKASGYTFFEYIIHWVKQ KSGQGLEWIGWFYPGSGNIKYNEKFKDKATLTADKSSST VYMELSRLTSEDSAVYFCTRHEGGSNFFPYWGQGTLVTV SA |
| SEQ ID NO: 196 | CDH17E2/TR2v1 (IgG1 KO) HC | QVQLQQSDAELVKPGASVKISCKVSGYTFTDHTIHWMKQ RPEQGLEWIGYIYPRDVITQYNEKFKGKATLTADKSSST AYMQLNSLTSEDSAVYLCARWGYFYGSRSYYFDYWGQGT TLTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSDIELTQDPAV SVALGQTVRITCQGDSLRSYYASWYQQKPGQAPVLVIYG KNNRPSGIPDRFSGSSSGNTASLTITGAQAEDEADYYCN SRDSSGNHVVFGCGTKLTVLGGGGSGGGGSGGGGSGGGG SEVQLVQSGGGVERPGGSLRLSCAASGFTFDDYGMSWVR QAPGKCLEWVSGINWNGGSTGYADSVKGRVTISRDNAKN SLYLQMNSLRAEDTAVYYCAKILGAGRGWYFDLWGKGTT VTVSS |
| SEQ ID NO: 197 | CDH17E2/TR2v2 (IgG1 KO) HC | QVQLQQSDAELVKPGASVKISCKVSGYTFTDHTIHWMKQ RPEQGLEWIGYIYPRDVITQYNEKFKGKATLTADKSSST AYMQLNSLTSEDSAVYLCARWGYFYGSRSYYFDYWGQGT TLTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN |

TABLE 3-continued

Amino acid sequences and SEQ ID NOs of CDRs, VH, VL, scFv, light and heavy chains of the binding molecules and antibodies of the invention.

| SEQ ID Number | Brief description of sequence | Sequence |
|---|---|---|
| | | GQPENNYKTTPPVLDSDGSFFLYSKLTVDKSRWQQGNVF<br>SCSVMHEALHNHYTQKSLSLSPGGGSGGSSSELTQDPAV<br>SVALGQTVRITCQGDSLRSYYASWYQQKPGQAPVLVIYG<br>KNNRPSGIPDRFSGSSSGNTASLTITGAQAEDEADYYCN<br>SRDSSGNHVVFGGGTKLTVLGGGGSGGGGSGGGGSGGGG<br>SEVQLVQSGGGVERPGGSLRLSCAASGFTFDDYGMSWVR<br>QAPGKGLEWVSGINWNGGSTGYADSVKGRVTISRDNAKN<br>SLYLQMNSLRAEDTAVYYCAKILGAGRGWYFDLWGKGTT<br>VTVSS |
| SEQ ID NO: 198 | CDH17E2/TR2v3<br>HC(IgG1 KO) | QVQLQQSDAELVKPGASVKISCKVSGYTFTDHTIHWMKQ<br>RPEQGLEWIGYIYPRDVITQYNEKFKGKATLTADKSSST<br>AYMQLNSLTSEDSAVYLCARWGYFYGSRSYYFDYWGQGT<br>TLTVSSASTKGPSVFPLAPSSKSTSGGTAALGCLVKDYF<br>PEPVTVSWNSGALTSGVHTFPAVLQSSGLYSLSSVVTVP<br>SSSLGTQTYICNVNHKPSNTKVDKRVEPKSCDKTHTCPP<br>CPAPEAAGGPSVFLFPPKPKDTLMISRTPEVTCVVVDVS<br>HEDPEVKFNWYVDGVEVHNAKTKPREEQYNSTYRVVSVL<br>TVLHQDWLNGKEYKCKVSNKALPAPIEKTISKAKGQPRE<br>PQVYTLPPSREEMTKNQVSLTCLVKGFYPSDIAVEWESN<br>GQPENNYKTTPPVLDSDGSFFLYSKLTVDKSRWQQGNVF<br>SCSVMHEALHNHYTQKSLSLSPGGGSGGSSSELTQDPAV<br>SVALGQTVRITCQGDSLRSYYASWYQQKPGQAPVLVIYG<br>KTNRPSGIPDRFSGSSSGNTASLTITGAQAEDEADYYCN<br>SRDSSGTHVVFGGGTKLTVLGGGGSGGGGSGGGGSGGGG<br>SEVQLVQSGGGVERPGGSLRLSCAASGFTFDDYGMSWVR<br>QAPGKGLEWVSGINWSGGSTGYADSVKGRVTISRDNAKN<br>SLYLQMNSLRAEDTAVYYCAKILGAGRGWYFDLWGKGTT<br>VTVSS |
| SEQ ID NO: 199 | CDH17E2/TR2v4<br>HC | QVQLQQSDAELVKPGASVKISCKVSGYTFTDHTIHWMKQ<br>RPEQGLEWIGYIYPRDVITQYNEKFKGKATLTADKSSST<br>AYMQLNSLTSEDSAVYLCARWGYFYGSRSYYFDYWGQGT<br>TLTVSSASTKGPSVFPLAPSSKSTSGGTAALGCLVKDYF<br>PEPVTVSWNSGALTSGVHTFPAVLQSSGLYSLSSVVTVP<br>SSSLGTQTYICNVNHKPSNTKVDKRVEPKSCDKTHTCPP<br>CPAPEAAGGPSVFLFPPKPKDTLMISRTPEVTCVVVDVS<br>HEDPEVKFNWYVDGVEVHNAKTKPREEQYNSTYRVVSVL<br>TVLHQDWLNGKEYKCKVSNKALPAPIEKTISKAKGQPRE<br>PQVYTLPPSREEMTKNQVSLTCLVKGFYPSDIAVEWESN<br>GQPENNYKTTPPVLDSDGSFFLYSKLTVDKSRWQQGNVF<br>SCSVMHEALHNHYTQKSLSLSPGGGSGGSSSELTQDPAV<br>SVALGQTVRITCQGDSLRSYYASWYQQKPGQAPVLVIYG<br>KANRPSGIPDRFSGSSSGNTASLTITGAQAEDEADYYCN<br>SRDSSGAHVVFGGGTKLTVLGGGGSGGGGSGGGGSGGGG<br>SEVQLVQSGGGVERPGGSLRLSCAASGFTFDDYGMSWVR<br>QAPGKGLEWVSGINWSGGSTGYADSVKGRVTISRDNAKN<br>SLYLQMNSLRAEDTAVYYCAKILGAGRGWYFDLWGKGTT<br>VTVSS |
| SEQ ID NO: 200 | CDH17E2/TR2v5<br>(IgG1 KO) HC | QVQLQQSDAELVKPGASVKISCKVSGYTFTDHTIHWMKQ<br>RPEQGLEWIGYIYPRDVITQYNEKFKGKATLTADKSSST<br>AYMQLNSLTSEDSAVYLCARWGYFYGSRSYYFDYWGQGT<br>TLTVSSASTKGPSVFPLAPSSKSTSGGTAALGCLVKDYF<br>PEPVTVSWNSGALTSGVHTFPAVLQSSGLYSLSSVVTVP<br>SSSLGTQTYICNVNHKPSNTKVDKRVEPKSCDKTHTCPP<br>CPAPEAAGGPSVFLFPPKPKDTLMISRTPEVTCVVVDVS<br>HEDPEVKFNWYVDGVEVHNAKTKPREEQYNSTYRVVSVL<br>TVLHQDWLNGKEYKCKVSNKALPAPIEKTISKAKGQPRE<br>PQVYTLPPSREEMTKNQVSLTCLVKGFYPSDIAVEWESN<br>GQPENNYKTTPPVLDSDGSFFLYSKLTVDKSRWQQGNVF<br>SCSVMHEALHNHYTQKSLSLSPGGGSGGSSSELTQDPAV<br>SVALGQTVRITCQGDSLRSYYASWYQQKPGQAPVLVIYG<br>KNNRPSGIPDRFSGSSSGNTASLTITGAQAEDEADYYCN<br>SRDSSGNHVVFGGGTKLTVLGGGGSGGGGSGGGGSGGGG<br>SEVQLVQSGGGVERPGGSLRLSCAASGFTFDDYGMSWVR<br>QAPGKGLEWVSGINWSGGSTGYADSVKGRVTISRDNAKN<br>SLYLQMNSLRAEDTAVYYCAKILGAGRGWYFDLWGKGTT<br>VTVSS |
| SEQ ID NO: 201 | CDH17E2/TR2v6<br>(IgG1 KO) HC | QVQLQQSDAELVKPGASVKISCKVSGYTFTDHTIHWMKQ<br>RPEQGLEWIGYIYPRDVITQYNEKFKGKATLTADKSSST<br>AYMQLNSLTSEDSAVYLCARWGYFYGSRSYYFDYWGQGT<br>TLTVSSASTKGPSVFPLAPSSKSTSGGTAALGCLVKDYF |

TABLE 3-continued

Amino acid sequences and SEQ ID NOs of CDRs, VH, VL, scFv, light and heavy chains of the binding molecules and antibodies of the invention.

| SEQ ID Number | Brief description of sequence | Sequence |
|---|---|---|
| | | PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSSELTQDPAV SVALGQTVRITCQGDSLRSYYASWYQQKPGQAPVLVIYG KTNRPSGIPDRFSGSSSGNTASLTITGAQAEDEADYYCN SRDSSGDHVVFGGGTKLTVLGGGGSGGGGSGGGGSGGGG SEVQLVQSGGGVERPGGSLRLSCAASGFTFDDYGMSWVR QAPGKGLEWVSGINWAGGSTGYADSVKGRVTISRDNAKN SLYLQMNSLRAEDTAVYYCAKILGAGRGWYFDLWGKGTT VTVSS |
| SEQ ID NO: 202 | CDH17E2/TR2v7 (IgG1 KO) HC | QVQLQQSDAELVKPGASVKISCKVSGYTFTDHTIHWMKQ RPEQGLEWIGYIYPRDVITQYNEKFKGKATLTADKSSST AYMQLNSLTSEDSAVYLCARWGYFYGSRSYYFDYWGQGT TLTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSSELTQDPAV SVALGQTVRITCQGDSLRSYYASWYQQKPGQAPVLVIYG KDNRPSGIPDRFSGSSSGNTASLTITGAQAEDEADYYCN SRDSSGDHVVFGGGTKLTVLGGGGSGGGGSGGGGSGGGG SEVQLVQSGGGVERPGGSLRLSCAASGFTFDDYGMSWVR QAPGKGLEWVSGINWTGGSTGYADSVKGRVTISRDNAKN SLYLQMNSLRAEDTAVYYCAKILGAGRGWYFDLWGKGTT VTVSS |
| SEQ ID NO: 203 | CDH17E2 LC | DIVMTQSQKFMSTTVGDRVNITCKASQNVGTAVAWYQQK PGQSPKLLIYSASNRYTGVPDRFTGSGSGTDFTLTITNM QSKDLADYFCQQYSSYPWTFGGGTKLEIKRTVAAPSVFI FPPSDEQLKSGTASVVCLLNNFYPREAKVQWKVDNALQS GNSQESVFEQDSKDSTYSLSSTLTLSKADYEKHKVYACE VTHQGLSSPVTKSFNRGEC |
| SEQ ID NO: 204 | CDH17H2/TR2#1 (IgG1 KO) HC | QVQLVQSGAEVKKPGSSVKVSCKVSGYTFTDHTIHWMKQ RPGQGLEWIGYIYPRDVITQYNEKFKGKVTLTADKSTST AYMELSSLRSEDTAVYLCARWGYFYGSRSYYFDYWGQGT TVTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSDIVMTQSHKF MSTSVGDRVSITCKASQDVITAVAWYQQKPGQSPKLLIY WASTRHTGVPDRFTGTGSGTDYTLTISSVQAEDLALYYC QQHYSTPWTFGGGTKLEIKGGGGSGGGGSGGGGSGGGGS QVQLQQSGAELVKPGASVKLSCKAFDYTFTSYDINWVKQ RPGQGLEWIGWIDPGSGNTKYNEKFKGKATLTADKSSST AYMHLSSLTSEDSAVYFCARKNYGGSYAFTYWGQGTLVT VA |
| SEQ ID NO: 205 | CDH17H2/TR2#2 (IgG1 KO) HC | QVQLVQSGAEVKKPGSSVKVSCKVSGYTFTDHTIHWMKQ RPGQGLEWIGYIYPRDVITQYNEKFKGKVTLTADKSTST AYMELSSLRSEDTAVYLCARWGYFYGSRSYYFDYWGQGT TVTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF |

TABLE 3-continued

Amino acid sequences and SEQ ID NOs of CDRs, VH, VL, scFv, light and heavy chains of the binding molecules and antibodies of the invention.

| SEQ ID Number | Brief description of sequence | Sequence |
| --- | --- | --- |
| | | SCSVMHEALHNHYTQKSLSLSPGGGSGGSDIVMTQSHKF MSTSVGDRVSITCKASQDVSTAVAWYQQKPGQSPKVLIY WASTRHTGVPDRFTGSGSGTDYILTISSVQAEDLALYYC QQHYSTPYTFGGGTKLEIKGGGGSGGGGSGGGGSGGGGS KVQLQQSGAELVKTGTSVKLSCKASGYTFFEYIIHWVKQ RSGQGLEWIGWFYPGSGSIKYNEKFKDKATLTADKSSST VYMELSRLTSEDSAVYFCARHEEGGYSAWFPYWGQGTLV TVSA |
| SEQ ID NO: 206 | CDH17H2/TR2#3 (IgG1 KO) HC | QVQLVQSGAEVKKPGSSVKVSCKVSGYTFTDHTIHWMKQ RPGQGLEWIGYIYPRDVITQYNEKFKGKVTLTADKSTST AYMELSSLRSEDTAVYLCARWGYFYGSRSYYFDYWGQGT TVTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSDVLMTQTPLS LPVSLGDQASISCRSSQSIVHSNGDTYLDWYLQKPGQSP KLLIYKVSNRFSGVPDRFSGSGSGTDFTLKISRVVAEDL GVYYCFRGSHIPPTFGAGTKLEKGGGGSGGGGSGGGGSG GGGSEVQLQQSGPELVKPGASVKISCKASGYTFTDYYYL NWVKQSHGKSLEWIGYIYPNNGDTSYNQKFKGKTTLTVD KSSSTAYMEFRSLTSEDSAVYYCTRGSNWIWYFDVWGTG TTVTVSS |
| SEQ ID NO: 207 | CDH17H2/TR2#7 (IgG1 KO) HC | QVQLVQSGAEVKKPGSSVKVSCKVSGYTFTDHTIHWMKQ RPGQGLEWIGYIYPRDVITQYNEKFKGKVTLTADKSTST AYMELSSLRSEDTAVYLCARWGYFYGSRSYYFDYWGQGT TVTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSSIVMTQTPKF LPVSAGDRVTMTCKASQNVGNNVAWYQQKPGQSPKLLIS YASNRYTGVPDRFTGSGSGTDFFTISSVQVEDLAVYFCQ QHYSSPLTFGAGTKLELKGGGGSGGGGSGGGGSGGGGSQ VQLKQSGAELVKPGASVKISCKASGYSFTDYYINWVKQR PGQGLEWIGKIGPGSGNTYYNEKFEGKATLTADKSSSTA YMQLSSLTSEDSAVYFCASTGPFAYWGQGTLVTWSA |
| SEQ ID NO: 208 | CDH17H2/TR2#8 (IgG1 KO) HC | QVQLVQSGAEVKKPGSSVKVSCKVSGYTFTDHTIHWMKQ RPGQGLEWIGYIYPRDVITQYNEKFKGKVTLTADKSTST AYMELSSLRSEDTAVYLCARWGYFYGSRSYYFDYWGQGT TVTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSDIVMTQSHKF MSTSVGDRVSITCKASQDVGTAVAWYQQKPGQSPKLLIY WASTRHTGVPDRFTGSGSGTDFTLTISNVQSEDLADYFC QQYSSYPYTFGGGTKLEIKGGGGSGGGGSGGGGSGGGGS QVTLKESGPGILQPSQTLSLTCSFSGFSLSTSGMGVSWI RQPSGKGLEWLAHIYWDDDKRYNPSLKSRLTISKDTSRN QVFLKITSVDTADTATYYCARRRLGPFAYWGQGTLVTVS A |
| SEQ ID NO: 209 | CDH17H2/TR2#10 (IgG1 KO) HC | QVQLVQSGAEVKKPGSSVKVSCKVSGYTFTDHTIHWMKQ RPGQGLEWIGYIYPRDVITQYNEKFKGKVTLTADKSTST AYMELSSLRSEDTAVYLCARWGYFYGSRSYYFDYWGQGT TVTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP |

TABLE 3-continued

Amino acid sequences and SEQ ID NOs of CDRs, VH, VL, scFv, light and heavy chains of the binding molecules and antibodies of the invention.

| SEQ ID Number | Brief description of sequence | Sequence |
|---|---|---|
| | | CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGGSDVLMTQTPLS LPVSLGDQASISCRSSQNIVHSNGNTYLDWYLQKPGQSP KLLIYKVSNRFSGVPDRFSGSGSGTDFTLKISRVEAEDL GVYYCFQGSHVPPTFGAGTKLELKGGGGSGGGGSGGGGS GGGGSEVQLQQSGPELVKPGASVKISCKASGYTFTDYYY MNWVKQSHGKSLEWIGYIYPNNGGTRYNQKFKGKATLTV DKSSSTAYMELRSLTSEDSAVYYCARGGNWNWYFDVWGT GTTVTVSS |
| SEQ ID NO: 210 | CDH17H2/TR2#12 (IgG1 KO) HC | QVQLVQSGAEVKKPGSSVKVSCKVSGYTFTDHTIHWMKQ RPGQGLEWIGYIYPRDVITQYNEKFKGKVTLTADKSTST AYMELSSLRSEDTAVYLCARWGYFYGSRSYYFDYWGQGT TVTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGGSDIVMTQSHKF MSTSVGDRVSITCKASQDVSNAVAWYQQKPGQSPKLLIY WASTRHNGVPDRFTGSGSGTDYILTISSVQAEDLALYYC QQHYRTPYTFGGGTKLEIKGGGGSGGGGSGGGGSGGGGS KVQLQQSGAELVKPGASVKLSCKASGYTFTEYIIHWVKQ KSGQGLEWIGWFYPGSGNIKYNEKFKDKATLTADKSSST VYMELSRLTSEDSAVYFCTRHEGGSNFFPYWGQGTLVTV SA |
| SEQ ID NO: 211 | CDH17H2/TR2v1 HC | QVQLVQSGAEVKKPGSSVKVSCKVSGYTFTDHTIHWMKQ RPGQGLEWIGYIYPRDVITQYNEKFKGKVTLTADKSTST AYMELSSLRSEDTAVYLCARWGYFYGSRSYYFDYWGQGT TVTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGGSDIELTQDPAV SVALGQTVRITCQGDSLRSYYASWYQQKPGQAPVLVIYG KNNRPSGIPDRFSGSSSGNTASLTITGAQAEDEADYYCN SRDSSGNHVVFGCGTKLTVLGGGGSGGGGSGGGGSGGGG SEVQLVQSGGGVERPGGSLRLSCAASGFTFDDYGMSWVR QAPGKCLEWVSGINWNGGSTGYADSVKGRVTISRDNAKN SLYLQMNSLRAEDTAVYYCAKILGAGRGWYFDLWGKGTT VTVSS |
| SEQ ID NO: 212 | CDH17H2/TR2v2 (IgG1 KO) HC | QVQLVQSGAEVKKPGSSVKVSCKVSGYTFTDHTIHWMKQ RPGQGLEWIGYIYPRDVITQYNEKFKGKVTLTADKSTST AYMELSSLRSEDTAVYLCARWGYFYGSRSYYFDYWGQGT TVTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGGSSSELTQDPAV SVALGQTVRITCQGDSLRSYYASWYQQKPGQAPVLVIYG KNNRPSGIPDRFSGSSSGNTASLTITGAQAEDEADYYCN SRDSSGNHVVFGGGTKLTVLGGGGSGGGGSGGGGSGGGG SEVQLVQSGGGVERPGGSLRLSCAASGFTFDDYGMSWVR QAPGKGLEWVSGINWNGGSTGYADSVKGRVTISRDNAKN SLYLQMNSLRAEDTAVYYCAKILGAGRGWYFDLWGKGTT VTVSS |

TABLE 3-continued

Amino acid sequences and SEQ ID NOs of CDRs, VH, VL, scFv, light and heavy chains of the binding molecules and antibodies of the invention.

| SEQ ID Number | Brief description of sequence | Sequence |
| --- | --- | --- |
| SEQ ID NO: 213 | CDH17H2/TR2v3 (IgG1 KO) HC | QVQLVQSGAEVKKPGSSVKVSCKVSGYTFTDHTIHWMKQ RPGQGLEWIGYIYPRDVITQYNEKFKGKVTLTADKSTST AYMELSSLRSEDTAVYLCARWGYFYGSRSYYFDYWGQGT TVTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSSSELTQDPAV SVALGQTVRITCQGDSLRSYYASWYQQKPGQAPVLVIYG KTNRPSGIPDRFSGSSSGNTASLTITGAQAEDEADYYCN SRDSSGTHVVFGGGTKLTVLGGGSGGGGSGGGGSGGGG SEVQLVQSGGGVERPGGSLRLSCAASGFTFDDYGMSWVR QAPGKGLEWVSGINWSGGSTGYADSVKGRVTISRDNAKN SLYLQMNSLRAEDTAVYYCAKILGAGRGWYFDLWGKGTT VTVSS |
| SEQ ID NO: 214 | CDH17H2/TR2v4 (IgG1 KO) HC | QVQLVQSGAEVKKPGSSVKVSCKVSGYTFTDHTIHWMKQ RPGQGLEWIGYIYPRDVITQYNEKFKGKVTLTADKSTST AYMELSSLRSEDTAVYLCARWGYFYGSRSYYFDYWGQGT TVTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSSSELTQDPAV SVALGQTVRITCQGDSLRSYYASWYQQKPGQAPVLVIYG KANRPSGIPDRFSGSSSGNTASLTITGAQAEDEADYYCN SRDSSGAHVVFGGGTKLTVLGGGSGGGGSGGGGSGGGG SEVQLVQSGGGVERPGGSLRLSCAASGFTFDDYGMSWVR QAPGKGLEWVSGINWSGGSTGYADSVKGRVTISRDNAKN SLYLQMNSLRAEDTAVYYCAKILGAGRGWYFDLWGKGTT VTVSS |
| SEQ ID NO: 215 | CDH17H2/TR2v5 (IgG1 KO) HC | QVQLVQSGAEVKKPGSSVKVSCKVSGYTFTDHTIHWMKQ RPGQGLEWIGYIYPRDVITQYNEKFKGKVTLTADKSTST AYMELSSLRSEDTAVYLCARWGYFYGSRSYYFDYWGQGT TVTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSSSELTQDPAV SVALGQTVRITCQGDSLRSYYASWYQQKPGQAPVLVIYG KNNRPSGIPDRFSGSSSGNTASLTITGAQAEDEADYYCN SRDSSGNHVVFGGGTKLTVLGGGSGGGGSGGGGSGGGG SEVQLVQSGGGVERPGGSLRLSCAASGFTFDDYGMSWVR QAPGKGLEWVSGINWSGGSTGYADSVKGRVTISRDNAKN SLYLQMNSLRAEDTAVYYCAKILGAGRGWYFDLWGKGTT VTVSS |
| SEQ ID NO: 216 | CDH17H2/TR2v6 (IgG1 KO) HC | QVQLVQSGAEVKKPGSSVKVSCKVSGYTFTDHTIHWMKQ RPGQGLEWIGYIYPRDVITQYNEKFKGKVTLTADKSTST AYMELSSLRSEDTAVYLCARWGYFYGSRSYYFDYWGQGT TVTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSSSELTQDPAV SVALGQTVRITCQGDSLRSYYASWYQQKPGQAPVLVIYG KTNRPSGIPDRFSGSSSGNTASLTITGAQAEDEADYYCN |

TABLE 3-continued

Amino acid sequences and SEQ ID NOs of CDRs, VH, VL, scFv, light and heavy chains of the binding molecules and antibodies of the invention.

| SEQ ID Number | Brief description of sequence | Sequence |
| --- | --- | --- |
| | | SRDSSGDHVVFGGGTKLTVLGGGGSGGGGSGGGGSGGGG SEVQLVQSGGGVERPGGSLRLSCAASGFTFDDYGMSWVR QAPGKGLEWVSGINWAGGSTGYADSVKGRVTISRDNAKN SLYLQMNSLRAEDTAVYYCAKILGAGRGWYFDLWGKGTT VTVSS |
| SEQ ID NO: 217 | CDH17H2/TR2v7 (IgG1 KO) HC | QVQLVQSGAEVKKPGSSVKVSCKVSGYTFTDHTIHWMKQ RPGQGLEWIGYIYPRDVITQYNEKFKGKVTLTADKSTST AYMELSSLRSEDTAVYLCARWGYFYGSRSYYFDYWGQGT TVTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSSSELTQDPAV SVALGQTVRITCQGDSLRSYYASWYQQKPGQAPVLVIYG KDNRPSGIPDRFSGSSSGNTASLTITGAQAEDEADYYCN SRDSSGDHVVFGGGTKLTVLGGGGSGGGGSGGGGSGGGG SEVQLVQSGGGVERPGGSLRLSCAASGFTFDDYGMSWVR QAPGKGLEWVSGINWTGGSTGYADSVKGRVTISRDNAKN SLYLQMNSLRAEDTAVYYCAKILGAGRGWYFDLWGKGTT VTVSS |
| SEQ ID NO: 218 | CDH17H2 LC | DIQMTQSQSSLSASVGDRVGITCKASQNVGTAVAWYQQK PGKAPKWYSASNRYTGVPSRFSGSGSGTDFTLTISSLQP KDFATYFCQQYSSYPWTFGQGTKLEIKRTVAAPSVFIFP PSDEQLKSGTASVVCLLNNFYPREAKVQWKVDNALQSGN SQESVTEQDSKDSTYSLSSTLTLSKADYEKHKVYACEVT HQGLSSPVTKSFNRGEC |
| SEQ ID NO: 219 | CDH17v1/TR2#1 (IgG1 KO) HC | EVQLQQSVAELVKPGASVKMSCKVSGYTLTDHTIHWMKQ RPEQGLEWIGYIYPRDGITGYNEKFKGKATLTADTSSST AYMQLNSLTSEDSAVYFCARWGYSYRNYAYYYDYWGQGT TLTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSDIVMTQSHKF MSTSVGDRVSITCKASQDVITAVAWYQQKPGQSPKLLIY WASTRHTGVPDRFTGTGSGTDYTLTISSVQAEDLALYYC QQHYSTPWTFGGGTKLEIKGGGGSGGGGSGGGGSGGGGS QVQLQQSGAELVKPGASVKLSCKAFDYTFTSYDINWVKQ RPGQGLEWIGWIDPGSGNTKYNEKFKGKATLTADKSSST AYMHLSSLTSEDSAVYFCARKNYGGSYAFTYWGQGTLVT VA |
| SEQ ID NO: 220 | CDH17v1/TR2#2 (IgG1 KO) HC | EVQLQQSVAELVKPGASVKMSCKVSGYTLTDHTIHWMKQ RPEQGLEWIGYIYPRDGITGYNEKFKGKATLTADTSSST AYMQLNSLTSEDSAVYFCARWGYSYRNYAYYYDYWGQGT TLTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSDIVMTQSHKF MSTSVGDRVSITCKASQDVSTAVAWYQQKPGQSPKVLIY WASTRHTGVPDRFTGSGSGTDYILTISSVQAEDLALYYC QQHYSTPYTFGGGTKLEIKGGGGSGGGGSGGGGSGGGGS KVQLQQSGAELVKTGTSVKLSCKASGYTFFEYIIHWVKQ RSGQGLEWIGWFYPGSGSIKYNEKFKDKATLTADKSSST VYMELSRLTSEDSAVYFCARHEEGGYSAWFPYWGQGTLV TVSA |

TABLE 3-continued

Amino acid sequences and SEQ ID NOs of CDRs, VH, VL, scFv, light and heavy chains of the binding molecules and antibodies of the invention.

| SEQ ID Number | Brief description of sequence | Sequence |
| --- | --- | --- |
| SEQ ID NO: 221 | CDH17v1/TR2#3 (IgG1 KO) HC | EVQLQQSVAELVKPGASVKMSCKVSGYTLTDHTIHWMKQ RPEQGLEWIGYIYPRDGITGYNEKFKGKATLTADTSSST AYMQLNSLTSEDSAVYFCARWGYSYRNYAYYYDYWGQGT TLTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSDVLMTQTPLS LPVSLGDQASISCRSSQSIVHSNGDTYLDWYLQKPGQSP KLLIYKVSNRFSGVPDRFSGSGSGTDFTLKISRVVAEDL GVYYCFRGSHIPPTFGAGTKLEKGGGGSGGGGSGGGGSG GGGSEVQLQQSGPELVKPGASVKISCKASGYTFTDYYYL NWVKQSHGKSLEWIGYIYPNNGDTSYNQKFKGKTTLTVD KSSSTAYMEFRSLTSEDSAVYYCTRGSNWIWYFDVWGTG TTVTVSS |
| SEQ ID NO: 222 | CDH17v1/TR2#7 (IgG1 KO) HC | EVQLQQSVAELVKPGASVKMSCKVSGYTLTDHTIHWMKQ RPEQGLEWIGYIYPRDGITGYNEKFKGKATLTADTSSST AYMQLNSLTSEDSAVYFCARWGYSYRNYAYYYDYWGQGT TLTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSSIVMTQTPKF LPVSAGDRVTMTCKASQNVGNNVAWYQQKPGQSPKLLIS YASNRYTGVPDRFTGSGSGTDFFTISSVQVEDLAVYFCQ QHYSSPLTFGAGTKLELKGGGGSGGGGSGGGGSGGGGSQ VQLKQSGAELVKPGASVKISCKASGYSFTDYYINWVKQR PGQGLEWIGKIGPGSGNTYYNEKFEGKATLTADKSSSTA YMQLSSLTSEDSAVYFCASTGPPFAYWGQGTLVTWSA |
| SEQ ID NO: 223 | CDH17v1/TR2#8 (IgG1 KO) HC | EVQLQQSVAELVKPGASVKMSCKVSGYTLTDHTIHWMKQ RPEQGLEWIGYIYPRDGITGYNEKFKGKATLTADTSSST AYMQLNSLTSEDSAVYFCARWGYSYRNYAYYYDYWGQGT TLTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSDIVMTQSHKF MSTSVGDRVSITCKASQDVGTAVAWYQQKPGQSPKLLIY WASTRHTGVPDRFTGSGSGTDFTLTISNVQSEDLADYFC QQYSSYPYTFGGGTKLEIKGGGGSGGGGSGGGGSGGGGS QVTLKESGPGILQPSQTLSLTCSFSGFSLSTSGMGVSWI RQPSGKGLEWLAHIYWDDDKRYNPSLKSRLTISKDTSRN QVFLKITSVDTADTATYYCARRRLGPFAYWGQGTLVTVS A |
| SEQ ID NO: 224 | CDH17v1/TR2#10 (IgG1 KO) HC | EVQLQQSVAELVKPGASVKMSCKVSGYTLTDHTIHWMKQ RPEQGLEWIGYIYPRDGITGYNEKFKGKATLTADTSSST AYMQLNSLTSEDSAVYFCARWGYSYRNYAYYYDYWGQGT TLTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSDVLMTQTPLS LPVSLGDQASISCRSSQNIVHSNGNTYLDWYLQKPGQSP KLLIYKVSNRFSGVPDRFSGSGSGTDFTLKISRVEAEDL GVYYCFQGSHVPPTFGAGTKLELKGGGGSGGGGSGGGGS |

TABLE 3-continued

Amino acid sequences and SEQ ID NOs of CDRs, VH, VL, scFv, light and heavy chains of the binding molecules and antibodies of the invention.

| SEQ ID Number | Brief description of sequence | Sequence |
|---|---|---|
| | | GGGGSEVQLQQSGPELVKPGASVKISCKASGYTFTDYYY MNWVKQSHGKSLEWIGYIYPNNGGTRYNQKFKGKATLTV DKSSSTAYMELRSLTSEDSAVYYCARGGNWNWYFDVWGT GTTVTVSS |
| SEQ ID NO: 225 | CDH17v1/TR2#12 (IgG1 KO) HC | EVQLQQSVAELVKPGASVKMSCKVSGYTLTDHTIHWMKQ RPEQGLEWIGYIYPRDGITGYNEKFKGKATLTADTSSST AYMQLNSLTSEDSAVYFCARWGYSYRNYAYYYDYWGQGT TLTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSDIVMTQSHKF MSTSVGDRVSITCKASQDVSNAVAWYQQKPGQSPKLLIY WASTRHNGVPDRFTGSGSGTDYILTISSVQAEDLALYYC QQHYRTPYTFGGGTKLEIKGGGGSGGGGSGGGGSGGGGS KVQLQQSGAELVKPGASVKLSCKASGYTFTEYIIHWVKQ KSGQGLEWIGWFYPGSGNIKYNEKFKDKATLTADKSSST VYMELSRLTSEDSAVYFCTRHEGGSNFFPYWGQGTLVTV SA |
| SEQ ID NO: 226 | CDH17v1/TR2v1 (IgG1 KO) HC | EVQLQQSVAELVKPGASVKMSCKVSGYTLTDHTIHWMKQ RPEQGLEWIGYIYPRDGITGYNEKFKGKATLTADTSSST AYMQLNSLTSEDSAVYFCARWGYSYRNYAYYYDYWGQGT TLTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSDIELTQDPAV SVALGQTVRITCQGDSLRSYYASWYQQKPGQAPVLVIYG KNNRPSGIPDRFSGSSSGNTASLTITGAQAEDEADYYCN SRDSSGNHVVFGCGTKLTVLGGGGSGGGGSGGGGSGGGG SEVQLVQSGGGVERPGGSLRLSCAASGFTFDDYGMSWVR QAPGKCLEWVSGINWNGGSTGYADSVKGRVTISRDNAKN SLYLQMNSLRAEDTAVYYCAKILGAGRGWYFDLWGKGTT VTVSS |
| SEQ ID NO: 227 | CDH17v1/TR2v2 (IgG1 KO) HC | EVQLQQSVAELVKPGASVKMSCKVSGYTLTDHTIHWMKQ RPEQGLEWIGYIYPRDGITGYNEKFKGKATLTADTSSST AYMQLNSLTSEDSAVYFCARWGYSYRNYAYYYDYWGQGT TLTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSSSELTQDPAV SVALGQTVRITCQGDSLRSYYASWYQQKPGQAPVLVIYG KNNRPSGIPDRFSGSSSGNTASLTITGAQAEDEADYYCN SRDSSGNHVVFGGGTKLTVLGGGGSGGGGSGGGGSGGGG SEVQLVQSGGGVERPGGSLRLSCAASGFTFDDYGMSWVR QAPGKGLEWVSGINWNGGSTGYADSVKGRVTISRDNAKN SLYLQMNSLRAEDTAVYYCAKILGAGRGWYFDLWGKGTT VTVSS |
| SEQ ID NO: 228 | CDH17v1/TR2v3 (IgG1 KO) HC | EVQLQQSVAELVKPGASVKMSCKVSGYTLTDHTIHWMKQ RPEQGLEWIGYIYPRDGITGYNEKFKGKATLTADTSSST AYMQLNSLTSEDSAVYFCARWGYSYRNYAYYYDYWGQGT TLTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE |

TABLE 3-continued

Amino acid sequences and SEQ ID NOs of CDRs, VH, VL, scFv, light and heavy chains of the binding molecules and antibodies of the invention.

| SEQ ID Number | Brief description of sequence | Sequence |
|---|---|---|
| | | PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSSSELTQDPAV SVALGQTVRITCQGDSLRSYYASWYQQKPGQAPVLVIYG KTNRPSGIPDRFSGSSSGNTASLTITGAQAEDEADYYCN SRDSSGTHVVFGGGTKLTVLGGGGSGGGGSGGGGSGGGG SEVQLVQSGGGVERPGGSLRLSCAASGFTFDDYGMSWVR QAPGKGLEWVSGINWSGGSTGYADSVKGRVTISRDNAKN SLYLQMNSLRAEDTAVYYCAKILGAGRGWYFDLWGKGTT VTVSS |
| SEQ ID NO: 229 | CDH17v1/TR2v4 (IgG1 KO) HC | EVQLQQSVAELVKPGASVKMSCKVSGYTLTDHTIHWMKQ RPEQGLEWIGYIYPRDGITGYNEKFKGKATLTADTSSST AYMQLNSLTSEDSAVYFCARWGYSYRNYAYYYDYWGQGT TLTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSSSELTQDPAV SVALGQTVRITCQGDSLRSYYASWYQQKPGQAPVLVIYG KANRPSGIPDRFSGSSSGNTASLTITGAQAEDEADYYCN SRDSSGAHVVFGGGTKLTVLGGGGSGGGGSGGGGSGGGG SEVQLVQSGGGVERPGGSLRLSCAASGFTFDDYGMSWVR QAPGKGLEWVSGINWSGGSTGYADSVKGRVTISRDNAKN SLYLQMNSLRAEDTAVYYCAKILGAGRGWYFDLWGKGTT VTVSS |
| SEQ ID NO: 230 | CDH17v1/TR2v5 (IgG1 KO) HC | EVQLQQSVAELVKPGASVKMSCKVSGYTLTDHTIHWMKQ RPEQGLEWIGYIYPRDGITGYNEKFKGKATLTADTSSST AYMQLNSLTSEDSAVYFCARWGYSYRNYAYYYDYWGQGT TLTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSSSELTQDPAV SVALGQTVRITCQGDSLRSYYASWYQQKPGQAPVLVIYG KNNRPSGIPDRFSGSSSGNTASLTITGAQAEDEADYYCN SRDSSGNHVVFGGGTKLTVLGGGGSGGGGSGGGGSGGGG SEVQLVQSGGGVERPGGSLRLSCAASGFTFDDYGMSWVR QAPGKGLEWVSGINWSGGSTGYADSVKGRVTISRDNAKN SLYLQMNSLRAEDTAVYYCAKILGAGRGWYFDLWGKGTT VTVSS |
| SEQ ID NO: 231 | CDH17v1/TR2v6 (IgG1 KO) HC | EVQLQQSVAELVKPGASVKMSCKVSGYTLTDHTIHWMKQ RPEQGLEWIGYIYPRDGITGYNEKFKGKATLTADTSSST AYMQLNSLTSEDSAVYFCARWGYSYRNYAYYYDYWGQGT TLTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSSSELTQDPAV SVALGQTVRITCQGDSLRSYYASWYQQKPGQAPVLVIYG KTNRPSGIPDRFSGSSSGNTASLTITGAQAEDEADYYCN SRDSSGDHVVFGGGTKLTVLGGGGSGGGGSGGGGSGGGG SEVQLVQSGGGVERPGGSLRLSCAASGFTFDDYGMSWVR QAPGKGLEWVSGINWAGGSTGYADSVKGRVTISRDNAKN SLYLQMNSLRAEDTAVYYCAKILGAGRGWYFDLWGKGTT VTVSS |
| SEQ ID NO: 232 | CDH17v1/TR2v7 (IgG1 KO) HC | EVQLQQSVAELVKPGASVKMSCKVSGYTLTDHTIHWMKQ RPEQGLEWIGYIYPRDGITGYNEKFKGKATLTADTSSST AYMQLNSLTSEDSAVYFCARWGYSYRNYAYYYDYWGQGT |

TABLE 3-continued

Amino acid sequences and SEQ ID NOs of CDRs, VH, VL, scFv, light and heavy chains of the binding molecules and antibodies of the invention.

| SEQ ID Number | Brief description of sequence | Sequence |
|---|---|---|
| | | TLTVSSASTKGPSVFPLAPSSKSTSGGTAALGCLVKDYF PEPVTVSWNSGALTSGVHTFPAVLQSSGLYSLSSVVTVP SSSLGTQTYICNVNHKPSNTKVDKRVEPKSCDKTHTCPP CPAPEAAGGPSVFLFPPKPKDTLMISRTPEVTCVVVDVS HEDPEVKFNWYVDGVEVHNAKTKPREEQYNSTYRVVSVL TVLHQDWLNGKEYKCKVSNKALPAPIEKTISKAKGQPRE PQVYTLPPSREEMTKNQVSLTCLVKGFYPSDIAVEWESN GQPENNYKTTPPVLDSDGSFFLYSKLTVDKSRWQQGNVF SCSVMHEALHNHYTQKSLSLSPGGGSGGSSSELTQDPAV SVALGQTVRITCQGDSLRSYYASWYQQKPGQAPVLVIYG KDNRPSGIPDRFSGSSSGNTASLTITGAQAEDEADYYCN SRDSSGDHVVFGGGTKLTVLGGGGSGGGGSGGGGSGGGG SEVQLVQSGGGVERPGGSLRLSCAASGFTFDDYGMSWVR QAPGKGLEWVSGINWTGGSTGYADSVKGRVTISRDNAKN SLYLQMNSLRAEDTAVYYCAKILGAGRGWYFDLWGKGTT VTVSS |
| SEQ ID NO: 233 | CDH17v1 LC | DIVMSQSPSSLAVSVGEKVTMSCKSSQSLLHSSNQKNYL AWYQQKPGQSPKVLIYWASTRESGVPDRFTGSGSGTDFT LTITSVKSEDLAVYYCQQYYSYPWTFGGGTRLEIKRTVA APSVFIFPPSDEQLKSGTASVVCLLNNFYPREAKVQWKV DNALQSGNSQESVTEQDSKDSTYSLSSTLTLSKADYEKH KVYACEVTHQGLSSPVTKSFNRGEC |
| SEQ ID NO: 270 | IgG1FcRnmut | ASTKGPSVFPLAPSSKSTSGGTAALGCLVKDYFPEPVTV SWNSGALTSGVHTFPAVLQSSGLYSLSSVVTVPSSSLGT QTYICNVNHKPSNTKVDKRVEPKSCDKTHTCPPCPAPEA AGGPSVFLFPPKPKDTLMISRTPEVTCVVVDVSHEDPEV KFNWYVDGVEVHNAKTKPREEQYNSTYRVVSVLTVLAQD WLNGKEYKCKVSNKALPAPIEKTISKAKGQPREPQVYTL PPSREEMTKNQVSLTCLVKGFYPSDIAVEWESNGQPENN YKTTPPVLDSDGSFFLYSKLTVDKSRWQQGNVFSCSVMH EALHNHYTQKSLSLSPG |
| SEQ ID NO: 271 | CDH17H2/TRv2 (IgG1FcRnmut) HC | QVQLVQSGAEVKKPGSSVKVSCKVSGYTFTDHTIHWMKQ RPGQGLEWIGYIYPRDVITQYNEKFKGKVTLTADKSTST AYMELSSLRSEDTAVYLCARWGYFYGSRSYYFDYWGQGT TSVTVSSASTKGPSVFPLAPSSKSTSGGTAALGCLVKDY FPEPVTVSWNSGALTSGVHTFPAVLQSSGLYSLSSVVTV PSSSLGTQTYICNVNHKPSNTKVDKRVEPKSCDKTHTCP PCPAPEAAGGPSVFLFPPKPKDTLMISRTPEVTCVVVDV SHEDPEVKFNWYVDGVEVHNAKTKPREEQYNSTYRVVSV LTVLAQDWLNGKEYKCKVSNKALPAPIEKTISKAKGQPR EPQVYTLPPSREEMTKNQVSLTCLVKGFYPSDIAVEWES NGQPENNYKTTPPVLDSDGSFFLYSKLTVDKSRWQQGNV FSCSVMHEALHNHYTQKSLSLSPGGGSGGSSSELTQDPA VSVALGQTVRITCQGDSLRSYYASWYQQKPGQAPVLVIY GKNNRPSGIPDRFSGSSSGNTASLTITGAQAEDEADYYC NSRDSSGNHVVFGGGTKLTVLGGGGSGGGGSGGGGSGGG GSEVQLVQSGGGVERPGGSLRLSCAASGFTFDDYGMSWV RQAPGKGLEWVSGINWNGGSTGYADSVKGRVTISRDNAK NSLYLQMNSLRAEDTAVYYCAKILGAGRGWYFDLWGKGT TVTVSS |
| SEQ ID NO: 272 | CDH17v1HCCDR3 | GYSYRNYAYYYDY |

Example 6: Increased Apoptotic Effect of the Bispecific Molecules Recognizing Human TRAILR2 and Human CDH17

Introduction

The Examples set out above show the preparation of bispecific molecules recognizing TRAILR2 and human CDH17. To determine the effect of these molecules in apoptosis induction, the inventors decided to examine whether the molecules could cause a reduction in cell viability, whether any such reduction was caused by apoptosis, and whether any apoptotic effect was mediated specifically by the bispecific TRAILR2/CDH17 binding molecules.

Developing a Cell-Based Assay.

Firstly, it was necessary to identify a cancer cell line which has TRAILR2 and CDH17 on the cell surface. The Colo-205 cell line is derived from a human Caucasian colon adenocarcinoma. It is a well-known laboratory cell culture tool. The inventors chose this as a candidate cell line to assess the function of the bispecific TRAILR2/CDH17 binding molecules. TRAILR2 and CDH17 protein surface expression on the Colo-205 cells was analyzed as follows. Cells were detached using Accutase (Sigma A6964) and washed twice with FACS buffer (PBS, Gibco 14190; 3% FCS, Gibco 26140; and 0.09% $NaN_3$, Sigma Aldrich S2002). Cells were counted using the ViCell (Beckman Coulter Life Sciences) and the cell number adjusted to 2-5×10$^6$ cells/ml. 100 µl/well cell suspension was seeded in 96-well round bottom plates.

After seeding the cells, the plate was centrifuged at 1200 rpm for 5 minutes and the supernatant were discarded. Cells were then incubated for 60 min at 4° C. with 100 µl/well of the primary antibody appropriated dilution. Cells were washed twice with FACS buffer and 100 µl/well of the appropriated dilution of secondary/conjugated antibodies was added. Cells with secondary antibodies were incubated for 45 min at 4° C. in the dark. After two washes with FACS buffer, cells were resuspended in 100 µl FACS buffer per well and analyzed in a FACS Canto (BD Biosciences).

For TRAILR2 detection, conjugated anti-human CD262 (DR5) PE (eBioscience, 12-9908-42) was used. For CDH17, the anti-CDH17 antibody (R&D Systems, MAB1032) was used, followed by a secondary antibody rabbit anti-mouse IgG PE (Dako, R0439). As controls, mouse IgG1 isotype control PE (eBioscience, 12-4714-42) and mouse IgG1 isotype control (AbDserotec, MCA928EL) were used respectively.

Figure 2:
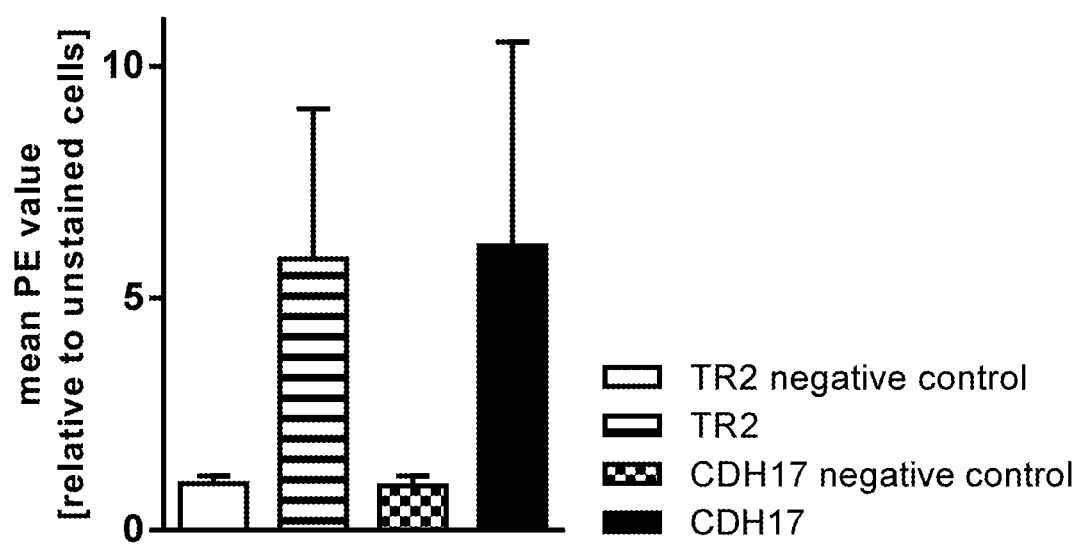
FIG. 2: Analysis of the protein surface expression of TRAILR2 (TR2) and CDH17 in Colo-205 cells. Results are shown as the mean PE values relative to the controls samples containing only cells. Data are representative of four independent experiments.

In FIG. 2 the protein surface expression of TRAILR2 and CDH17 in Colo-205 cells is shown, with both proteins proving significant expression.

Effect of the Bispecific TRAILR2/CDH17 Molecules on the Colo-205 Cells

Having identified Colo-205 cells as a suitable cancer cell line to assess the function of the bispecific TRAILR2/CDH17 binding molecules, the inventors devised the following assay.

Colo-205 cells were plated in culture medium (RPMI1640/Glutamax, Gibco 61870-010; plus 10% FCS, Gibco 26140). After resting overnight at 37° C. and 5% CO$_2$, cells were incubated during 24 h with 50 µl of different antibody or binding molecule dilutions at the desired concentrations. Cell viability was then assessed by using the CellTiter-Glo Luminescent Cell Viability Assay (Promega G7571) according to the instructions provided by the manufacturer. Finally, luminescence was recorded using the VICTOR X4 2030 Multilabel Plate Reader from Perkin Elmer.

Figure 3:
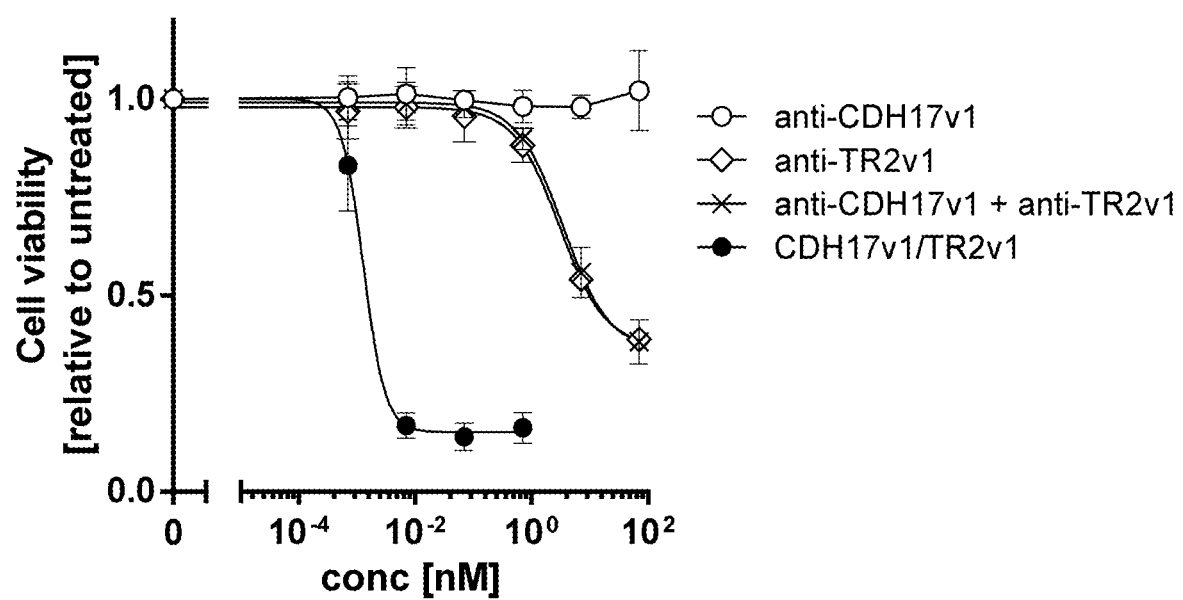
FIG. 3: Effect of antibodies incubation on cell viability. Colo-205 cells were treated for 24 h with different concentrations of (i) anti-TRAILR2 (anti-TR2v1) alone, (ii) anti-CDH17v1 alone, (iii) TRAILR2/CDH17 bispecific molecule (CDH17v1/TR2v1), or (iv) the equivalent combination of separate TRAILR2 (anti-TR2v1) and CDH17v1 antibodies. The data is expressed as mean relative values compared to untreated control plus standard deviation. Two independent assays were performed in duplicate for each condition.

The effect of the bispecific TRAILR2/CDH17 binding molecules on cell viability is shown in FIG. 3. Colo-205 cells were incubated for 24 hours with (i) the bispecific molecule, (ii) anti-TRAILR2 antibody alone, (iii) anti-CDH17 antibody alone, or (iv) the equivalent free-combination of TRAILR2 and CDH17 antibodies.

As shown in FIG. 3, the anti-CDH17 antibody had no effect in the viability of Colo-205 cells when used at a concentration range from 7×10$^{-4}$ to 70 nM. The TRAILR2 antibody was able to significantly decrease cell viability when used between 7 and 70 nM, and the addition of anti-CDH17 in free-combination did not change the effect observed with anti-TRAILR2 antibody alone. Finally, the incubation of Colo-205 cells with bispecific TRAIL-R2/CDH17 binding molecule as described herein (CDH17v1/TR2v1 comprising a heavy chain sequence of SEQ ID NO: 145 and a light chain sequence of SEQ ID NO: 146) resulted in a more than 1000 fold improved potency compared with both anti-TRAIL-R2 antibody (comprising an antigen binding site TRv1 with a VH and VL sequence of SEQ ID NO: 96 and SEQ ID NO: 97, respectively) alone and the anti-TRAIL-R2 antibody in combination with the anti-CDH17 antibody (comprising an antigen binding site CDH17v1 with a VH and VL sequence of SEQ ID NO: 118 and SEQ ID NO: 119, respectively).

TRAILR2/CDH17 Molecules Induces Apoptosis in the Colo-205 Cells

It was next investigated whether the reduction in cell viability as shown in FIG. 3 was caused by the induction of apoptosis. TRAIL-induced apoptosis is mediated by the recruitment and activation of caspase-8 which, in turn, activates the effector caspase-3 resulting in apoptosis. Hence to determine if the antibodies and binding molecules prepared herein are able to specifically activate the apoptotic pathway, the inventors measured both caspase-8 and -3 activities in target cell lines.

Caspase-3 and -8 activities were measured using the Promega Apo-ONE Homogeneous Caspase-3/7 Assay (Cat. #G7790), and the Promega Caspase-Glo 8 Assay (Cat. #G8201) respectively. After resting overnight at 37° C. and 5% CO$_2$, cells were incubated along different time-points with 50 µl of different antibody or binding molecule dilutions in order to achieve the desired concentrations. Caspase-3 and -8 activities were then assessed according to the instructions provided by the manufacturer. The luminescence of each sample was then measured using the VICTOR X4 2030 Multilabel Plate Reader from Perkin Elmer.

The results of this assay are shown in FIG. 4. Here it can be seen that both, the anti-TRAILR2 antibody (comprising an antigen binding site TRv1 with a VH and VL sequence of SEQ ID NO: 96 and SEQ ID NO: 97, respectively) alone and the bispecific TRAILR2/CDH17 binding molecules (CDH17v1/TR2v1 comprising a heavy chain sequence of SEQ ID NO: 145 and a light chain sequence of SEQ ID NO: 146) were able to efficiently activate both caspase 8 (A) and 3 (B). No effect was observed after the anti-CDH17 antibody (comprising an antigen binding site CDH17v1 with a VH and VL sequence of SEQ ID NO: 118 and SEQ ID NO: 119, respectively) incubation when compare to untreated controls. This data demonstrates that the decrease in cell viability observed in FIG. 3 is not due to any unspecific mechanism, and that both molecules are able to efficiently and specifically induce apoptosis in the target cells. In agreement with the cell viability data, the inventors observed that the incubation of Colo-205 cells with the bispecific TRAILR2/CDH17 binding molecules clearly resulted in superior caspase-8 and -3 activation (potency shift of more than 3 logs) compared with the anti-TRAILR2 antibody alone.

Apoptosis in the Colo-205 Cells is Specifically Induced by the Bispecific TRAILR2/CDH17 Molecules The inventors also wanted to confirm that the increase in apoptosis modulated by the bispecific TRAILR2/CDH17 binding molecules of the invention is specifically mediated by CDH17 present on the surface of the Colo-205 cells. To demonstrate this, the inventors generated an additional bispecific, tetravalent molecule recognizing human TRAILR2 and trinitrophenol (TNP) where the IgG master anti-CDH17 antibody was substituted for one recognizing TNP. The binding region to TNP acts as unspecific control for the molecule, as TNP antigen cannot be readily found on a cell surface.

Colo-205 cells were treated for 24 h with different concentrations of (i) an antibody to TNP alone, (ii) anti-CDH17 antibody alone, (iii) anti-TRAILR2 antibody alone, (iv) bispecific TRAILR2/TNP binding molecule, (v) bispecific TRAILR2/CDH17 molecules, and cell viability was measured. The data obtain is shown in FIG. 5.

Figure 5:
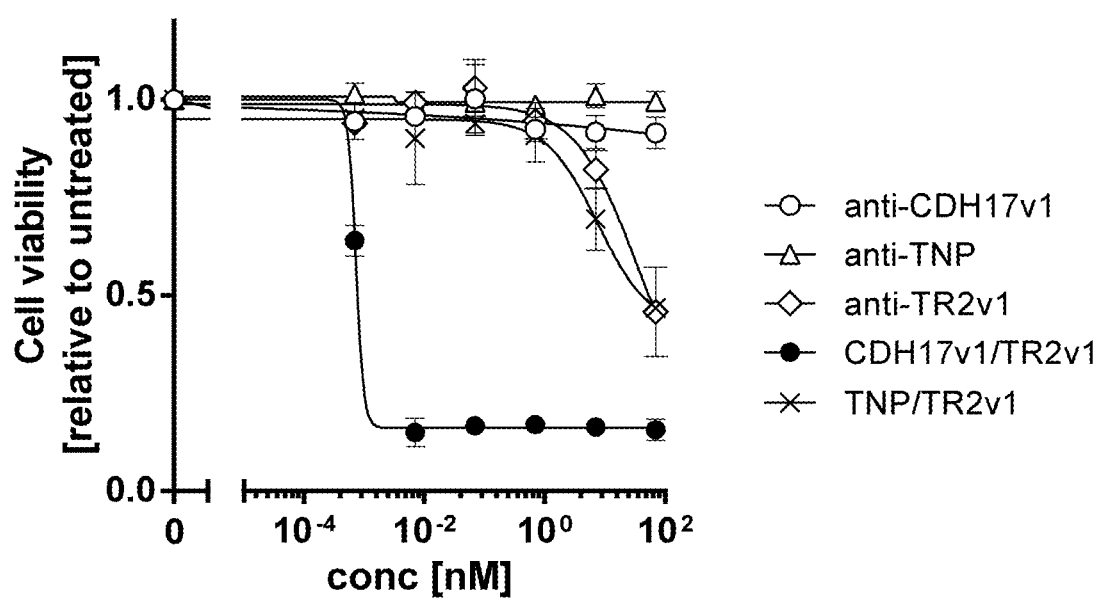
FIG. 5: Analysis of the specificity of CDH17v1/TR2v1 bispecific molecule. We generated an additional bispecific molecule recognizing human TR2 and trinitrophenol (TNP) instead of CDH17. Colo-205 cells were treated for 24 h with different concentrations of (i) an antibody to TNP alone, (ii) anti-CDH17v1 alone, (iii) anti-TRAILR2 (anti-TR2v1) alone, (iv) TNP/TR2v1, or (v) CDH17v1/TR2v1 bispecific molecule, and cell viability was measured. Data are expressed as mean relative values compare to untreated control plus standard deviation. Two independent assays were performed in duplicate for each condition.

As shown in FIG. 5, the bispecific TRAILR2/CDH17 binding molecule (CDH17v1/TR2v1 comprising a heavy chain sequence of SEQ ID NO: 145 and a light chain sequence of SEQ ID NO: 146) was able to induce a clear superior effect in decreasing cell viability compared with the anti-TRAILR2 antibody (comprising an antigen binding site TRv1 with a VH and VL sequence of SEQ ID NO: 96 and SEQ ID NO: 97, respectively). This effect is not seen with the bispecific TRAILR2/TNP binding molecule. Hence substituting CDH17 for TNP abolishes the superior apoptotic effect of the bispecific TRAILR2/CDH17 binding molecule, and the bispecific TRAILR2/TNP binding molecule has a comparable effect to the anti-TRAILR2 antibody alone.

Effect of the Bispecific TRAILR2/CDH17 Molecules on the HepG2 Cells

In order to study the effect of the bispecific TRAILR2/CDH17 binding molecules in liver derived CDH17 negative and TRAILR2 sensitive cells, a similar experiment as described above was performed using HepG2 cells. This cell line was originally derived from a liver hepatocellular carcinoma of a 15 year old Caucasian male.

HepG2 cells were cultured at 37° C. and 5% $CO_2$ in DMEM (Lonza, BE12-604F) plus 10% FCS (Gibco 26140).

As described for Colo-205, protein surface expression and cell viability was analysed as described in Example 3. In FIG. 6A, the protein surface expression of TRAILR2 and CDH17 in HepG2 cells is shown, with only TRAILR2 proving significant expression.

HepG2 cells were incubated with (i) anti-TRAILR2 (anti-TR2v1 comprising an antigen binding site TRv1 with a VH and VL sequence of SEQ ID NO: 96 and SEQ ID NO: 97, respectively) alone, (ii) TRAILR2/CDH17 bispecific binding molecule (CDH17v1/TR2v1 comprising a heavy chain sequence of SEQ ID NO: 145 and a light chain sequence of SEQ ID NO:146)). In addition, as a control for the maximal proapoptotic signaling of the anti-TRAILR2 antibody as described in the literature for various agonistic human TRAILR1 and TRAILR2 antibodies (Ichikawa et al., 2001. Nat Med. August; 7(8):954-60; Li et al., 2008 BMC Cancer. November 7; 8:325; Natoni et al., 2007, British journal of haematology 2007 November; 139(4):568-77; Pukac et al., 2005 Br J Cancer. 2005 Apr. 25; 92(8):1430-41; Yada et al., 2008 Ann Oncol. 2008 June; 19(6):1060-70; Zhang et al., 2007a Cancer Lett. 2007 Jun. 18; 251(1):146-57), HepG2 cells were also incubated with (iii) with anti-TRAILR2 (comprising an antigen binding site TRv1 with a VH and VL sequence of SEQ ID NO: 96 and SEQ ID NO: 97, respectively) in the presence of cross-linker, goat anti-human IgG (anti-TR2v1 (Fc crosslinking)). As shown in FIG. 6B, both the anti-TRAILR2 antibody alone and the TRAILR2/CDH17 bispecific molecule has no effect on the viability. Only the artificial Fc crosslinking of the TRAILR2 antibody was able to significantly decrease cell viability.

Effect of the Bispecific TRAILR2/CDH17 Molecules on Additional CRC Cells.

In order to study if the observed effect in Colo-205 can be applied to other CRC cell lines, a similar experiment as described above was performed using CL-34 (KRAS wild type) and SK-CO-1 (KRAS p.G12V) cells, two additional CRC cell lines.

CL-34 and SK-CO-1 cells were cultured at 37° C. and 5% $CO_2$ in DMEM/F-12 (ATCC 30-2006) plus 20% FCS (Gibco 26140) and EMEM (Lonza BE12-662F) plus 10% FCS (Gibco 26140) respectively.

As described in Example 6, protein surface expression and cell viability was analysed. In FIGS. 11A and 11B, the protein surface expression of TRAILR2 and CDH17 in CL-34 (A) and SK-CO-1 (B) cells is shown, with both proteins proving significant expression CL-34 and SK-CO-1 cells were incubated with (i) the bispecific TRAILR2/CDH17 binding molecule (CDH17v1/TR2v1 comprising a heavy chain of SEQ ID NO: 145 and a light chain of SEQ ID NO: 146)), (ii) anti-TRAILR2 antibody (comprising an antigen binding site TRv1 with a VH and VL sequence of SEQ ID NO: 96 and SEQ ID NO: 97, respectively) alone, or (iii) anti-CDH17 antibody (comprising an antigen binding site CDH17v1 with a VH and VL sequence of SEQ ID NO: 118 and SEQ ID NO: 119, respectively) alone. As shown in FIG. 11, the anti-CDH17 antibody has no effect on the viability while the TRAILR2 antibody was able to significantly decrease cell viability when used between 7 and 70 nM. As described for the Colo-205 cells, the incubation of both CL-34 and SK-CO-1 cells with bispecific TRAILR2/CDH17 binding molecules resulted in a clear potency shift of more than 3 logs on cell viability compared with the anti-TRAILR2 antibody alone.

In agreement to the similar response observed in CL-34 and SK-CO-1 cell, no significant difference in sensitivity between KRASmut and KRASwt cell lines was detected in an expanded panel of 19 CRC cell lines (Wilcoxon-Rank-Sum-Test, data not shown).

Discussion

The inventors have demonstrated above that the bispecific TRAILR2/CDH17 binding molecule induces apoptosis in CRC cell lines. This apoptotic effect is achieved using a concentration which is more than 3 orders of magnitude less than the TRAILR2 antibody alone and is at therapeutically useful dosage levels. It was also demonstrated that this effect is specifically trigger by the CDH17 portion of the bi-specific molecule, and that at the concentration of maximal effect, there was no detectable effect on the cell viability of the liver derived CDH17 negative and TRAILR2 sensitive HepG2 cells.

Example 7: Use of Different IgG Scaffolds in the Bispecific TRAILR2/CDH17 Molecule The inventors also investigated whether varying the IgG scaffold used in the master antibody element of the bispecific TRAILR2/CDH17 molecules altered the induction of apoptosis. Colo-205 cells were treated for 24 h with different concentrations of anti-TRAILR2 antibody alone and bispecific TRAILR2/CDH17 binding molecules comprising an IgG1(A and C) or IgG4Pro(B) constant region. After antibody incubation, cell viability was measured (FIG. 7).

As shown in FIG. 7, the substitution of the previously used IgG1 scaffold for a second version (IgG1 KO; SEQ ID NO: 121) with 2 additional mutations (L234A and L235A) or a third version (FcRnmut) with 1 additional mutation (H310A), SEQ ID NO: 270) did not change the effect on decreasing Colo-205 cell viability.

Similar to the wild-type version, the newly generated bispecific binding molecules (TRv1/CDH17v1 IgG1 (KO) comprising a heavy chain of SEQ ID NO:147 and a light chain of SEQ ID NO:148) were able to significantly decrease cell viability when used at concentrations as low as $10^{-2}$ nM, while the parental TRAILR2 antibody (comprising an antigen binding site TRv1 with VH and VL sequences of SEQ ID NO: 96 and SEQ ID NO: 97, respectively) showed no effect. This was also true for a second bispecific binding molecule where the TRAILR2 binding domain was substituted for a slightly modified sequence (TRAILR2v2, comprising a heavy chain of SEQ ID NO:149 and a light chain of SEQ ID NO:150 compared to anti-TR2v2 with VH and VL sequences of SEQ ID NO: 98 and SEQ ID NO: 99, respectively)). Furthermore, different bispecific molecules where the IgG scaffold used in the master antibody element of the bispecific scaffold was completely substituted for an IgG4 Pro isoform (comprising a heavy chain sequence of SEQ ID NO: 151 and a light chain sequence of SEQ ID NO: 152) or IgG1 FcRnmut (CDH17H2/TR2v2) comprising a heavy chain sequence of SEQ ID NO: 271 and a light chain sequence of SEQ ID NO: 218) were prepared. As shown in FIG. 7, this change in the molecule did not alter its potency in reducing Colo-205 cell viability.

Example 8: Effect of the scFv Variants in Decreasing Cell Viability

It was then investigated whether changes to the scFv second antibody component affects the induction of apoptosis by the molecule of the invention.

In the molecules used in Example 6, the scFv is oriented such that VL forms the N-terminus of the binding moiety, and is thus fused via a linker to the C-terminus of the heavy chain of the master antibody, while the VH of the scFv forms the C-terminus of the whole heavy chain molecule.

Therefore, a number of different bispecific TRAILR2/CDH17 binding molecules comprising binding sites defined by identical sequences of the variable domains but different orientation and/or further modifications of said domains (scFv versions 1 to 4) were generated.

1. The bispecific TRAILR2/CDH17 scFv1 molecule has a VH-VL orientation, i.e. the VH of the scFv is fused via the linker to the C-term of the antibody, and the VL of the scFv forms the C-terminus of the heavy chain whole molecule (CDH17v1/TRv1 with an scFv sequence of SEQ ID NO:131).

2. The bispecific TRAILR2/CDH17 scFv2 molecule also has a VH-VL orientation, i.e. the VH of the scFv is fused via the linker to the C-term of the antibody, and the VL of the scFv forms the C-terminus of the heavy chain whole molecule, and has additional disulfide bond to stabilize the scFv binding domain (CDH17v1/TRv1 with an scFv sequence of SEQ ID NO:132).

3. The bispecific TRAILR2/CDH17 scFv3 molecule is that used in FIG. 7 and so it has the VL-VH orientation, i.e. the VL of the scFv is fused via the linker to the C-term of the antibody, and the VH of the scFv forms the C-terminus of the heavy chain whole molecule (CDH17v1/TRv1 with an scFv sequence of SEQ ID NO:124).

4. The bispecific TRAILR2/CDH17 scFv4 molecule also has the VL-VH orientation, i.e. the VL of the scFv is fused via the linker to the C-term of the antibody, and the VH of the scFv forms the C-terminus of the heavy chain whole molecule, and has additional disulfide bond to stabilize the scFv binding domain (CDH17v1/TRv1 with an scFv sequence of SEQ ID NO:133).

The function of these variants of the bispecific TRAILR2/CDH17 binding molecules were then investigated in the Colo-205 cell apoptosis assay described in Example 6. After incubation with the binding molecules, cell viability was measured.

Figure 8:
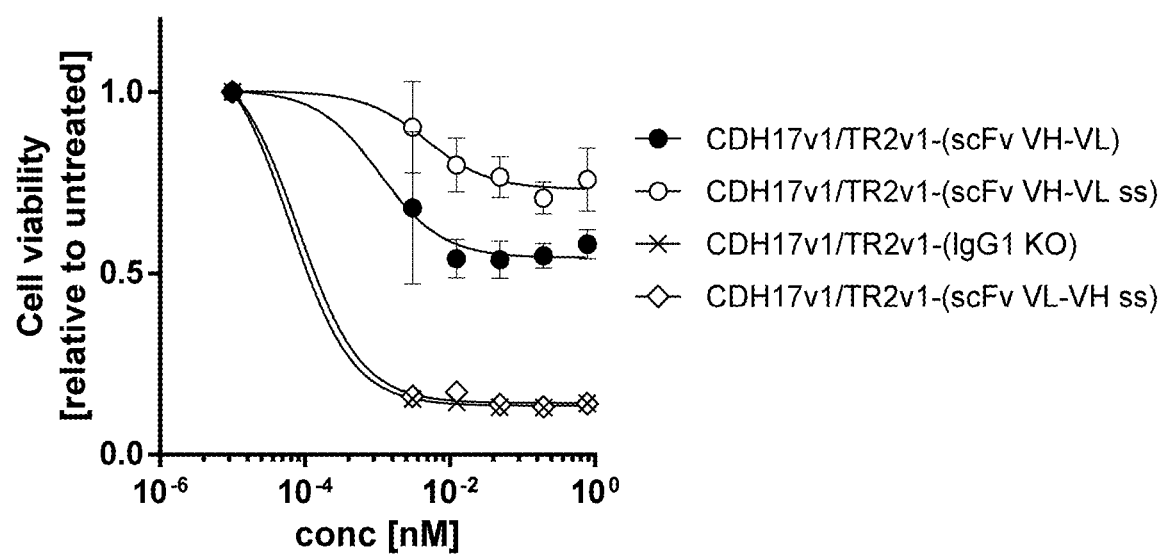
FIG. 8: Effect of scFv variants on cell viability. Colo-205 cells were treated for 24 h with different concentrations of different bispecific molecules containing different scFv variants. Data are expressed as mean relative values compare to untreated control plus standard deviation. Two independent assays were performed in duplicate for each condition.

The data presented in FIG. 8 shows that a bispecific TRAILR2/CDH17 binding molecule can induce Colo-205 cell apoptosis regardless of the orientation of the VH and VL domains within the scFv antibody domain, however, the VL-VH has a greater apoptotic effect than the VH-VL orientation. The molecules carrying the additional disulfide bond have no significant effect when compared with the corresponding parental molecules without these extra bonds.

Hence changes to the structure of the bispecific antibody format outlined in Example 1 can be tolerated, though the VL-VH does have a surprisingly greater apoptotic effect

Example 9: Effect of Bispecific Molecules TRAILR2 and CDH17 Bi-scFv Using Alternative Binding Sequences in Decreasing Colo-205 Cell Viability Variations of the bispecific TRAILR2/CDH17 binding molecules with different binding domains were prepared. Details of the specific binding molecules used are shown in the Tables in Example 5. The effect of varying the binding domains used on in the Colo-205 cell apoptosis assay as described in Example 6 was then investigated.

Colo-205 cells were treated for 24 h with different concentrations of different bispecific molecules containing different newly identified CDH17 (A) and TRAILR2 (B and C) binding sequences. After antibody incubation, cell viability was measured.

The data presented in FIG. 9 (A-C) demonstrates that bispecific binding molecules with different TRAILR2 and CDH17 binding sequences (CDH17A6/TR2v2 comprising HC of SEQ ID NO: 182 and LC of SEQ ID NO: 188; CDH17E2/TR2v2 comprising HC of SEQ OD NO: 197 and LC of SEQ ID NO: 203; CDH17E9/TR2v2 comprising HC of SEQ ID NO: 167 and LC of SEQ ID NO: 173; CDH17v1/TR2 #1 comprising HC of SEQ ID NO: 219 and LC of SEQ ID NO: 233, CDH17v1/TR2 #2 comprising HC of SEQ ID NO: 220 and LC of SEQ ID NO: 233; CDH17v1/TR2 #3 comprising HC of SEQ ID NO: 221 and LC of SEQ ID NO: 233; CDH17v1/TR2 #8 comprising HC of SEQ ID NO: 223 and LC of SEQ ID NO: 233; CDH17v1/TR2 #10 comprising HC of SEQ ID NO: 224 and LC of SEQ ID NO: 233; CDH17H2/TR2v2 comprising HC of SEQ ID NO: 212 and LC of SEQ ID NO: 218, CDH17H2/TR2v3 comprising HC of SEQ ID NO: 213 and LC of SEQ ID NO: 218; CDH17H2/TR2v4 comprising HC of SEQ ID NO: 214 and LC of SEQ ID NO: 218; CDH17H2/TR2v5 comprising HC of SEQ ID NO: 215 and LC of SEQ ID NO: 218; CDH17H2/TR2v6 comprising HC of SEQ ID NO: 216 and LC of SEQ ID NO: 218; CDH17H2/TR2v7 comprising HC of SEQ ID NO: 217 and LC of SEQ ID NO: 218) are able to significantly decrease cell viability when used at concentrations as low as $10^{-2}$ nM, while the parental TRAILR2 antibody (TR2v2 comprising a VH of SEQ ID NO: 98 and a VL of SEQ ID NO: 99) showed no effect at the same concentration. In FIG. 9D, some of these molecules CDH17H2/TR2v2 comprising HC of SEQ ID NO: 212 and LC of SEQ ID NO: 218, CDH17H2/TR2v3 comprising HC of SEQ ID NO: 213 and LC of SEQ ID NO: 218; CDH17H2/TR2v4 comprising HC of SEQ ID NO: 214 and LC of SEQ ID NO: 218; CDH17H2/TR2v5 comprising HC of SEQ ID NO: 215 and LC of SEQ ID NO: 218; CDH17H2/TR2v6 comprising HC of SEQ ID NO: 216 and LC of SEQ ID NO: 218; CDH17H2/TR2v7 comprising HC of SEQ ID NO: 217 and LC of SEQ ID NO: 218) were tested in the above mentioned liver derived CDH17 negative and TRAILR2 sensitive HepG2 cells. As showed in the figure, concentrations up to 1 nM have no detectable effect in HepG2 cell viability for any of the molecule tested. In FIGS. 9C-D it is also shown that the parental CDH17 antibody (CDH17H2 comprising a VH of SEQ ID NO: 116 and a VL of SEQ ID NO: 117) showed no effect decreasing cell viability of neither Colo-205 nor HepG2 within the range of concentration tested.

Hence different TRAILR2 and CDH17 binding sequences can be used in the bispecific TRAILR2/CDH17 binding molecules of the invention.

Example 10: Bispecific Molecules Recognizing TRAILR2 and CD44v6 have No Additional Effect in Decreasing Colo-205 Cell Viability It was also investigated whether an alternative anchor target can be used in replacement of CDH17. Hence a bispecific molecule recognizing TRAILR2 and CD44v6 was prepared.

As in Example 6, we first measured TRAILR2 and CD44v6 protein surface expression by FACS. For CD44v6 detection the BIWA1 antibody followed by a secondary antibody goat anti-mouse IgG PE (Dako, R0480) was used. As controls, mouse IgG1 isotype control (AbDserotec, MCA928EL) was used.

In FIG. 10A the protein surface expression of TRAILR2 and CD44v6 in Colo-205 cells is shown, with both proteins proving significant expression.

Cell viability was then measured using the CellTiter-Glo Luminescent Cell Viability Assay. Colo-205 cells were incubated with either the TRAILR2/CD44v6 bispecific binding molecule, anti-TRAILR2 antibody alone or anti-CD44v6 antibody alone. The data is presented in FIG. 10B.

Incubation of anti-CD44v6 antibody over a concentration range from $10^{-2}$ ng/ml to 10 mg/ml nM has no effect in the viability of Colo-205 cells. The incubation with anti-TRAILR2 antibody (TR2v1 comprising VH of SEQ ID NO: 96 and VL of SEQ ID NO: 97) was able to significantly decreased cell viability when used between 0.1 µg/ml and 10 µg/ml, and the incubation of Colo-205 cells with the equivalent amount of the bispecific, tetravalent molecule recognizing human TRAILR2 and human CD44v6 was not different from the effect observed with anti-TRAILR2 antibody alone.

Thus, CD44v6 cannot be used as an anchor target to modulate TRAILR2 induced apoptosis in the Colo-205 cells.

Example 11: In Vivo Efficacy of Bispecific Molecules in CRC Xenograft Models

The in vivo efficacy of binding molecules recognizing TRAILR2 and CDH17 was also investigated. For this purpose, Colo205 (KRAS wild type) and Gp2d (KRAS p.G12D), human CRC cancer cell lines expressing both TRAILR2 and CDH17 were engrafted into immunodeficient mice and the effect of the administration of a molecule of the invention on the tumor volume was measured.

Female BomTac:NMRI-Foxn1nu-homozygous mice were subcutaneously engrafted with $5.0 \times 10^6$ Colo205 cells (0.1 mL PBS+5% FCS) or $5.0 \times 10^6$ Gp2d cells (0.1 mL with cells:Matrigel ratio of 1:1 (v/v)) and the tumor growth was monitored until it reached 180-200 mm³. Mice were randomized in two groups and a single injection of vehicle control or a binding molecule of the invention—5 mg/Kg for Colo205 and 1.67 mg/Kg for Gp2d [CDH17H2/TR2v2-(Ig G1 KO) comprising a heavy chain sequence of SEQ ID NO: 212 and a light chain sequence of SEQ ID NO: 218]; 5 mg/Kg for Colo205 and Gp2d [CDH17H2/TR2v2-(Ig G1 FcRnmut) comprising a heavy chain sequence of SEQ ID NO: 271 and a light chain sequence of SEQ ID NO: 218]—was administered.

The data presented in FIG. 12 demonstrates that binding molecules of the invention are able to induce significant and extended reductions of the tumor volume when compared with the control group.

Figure 13:
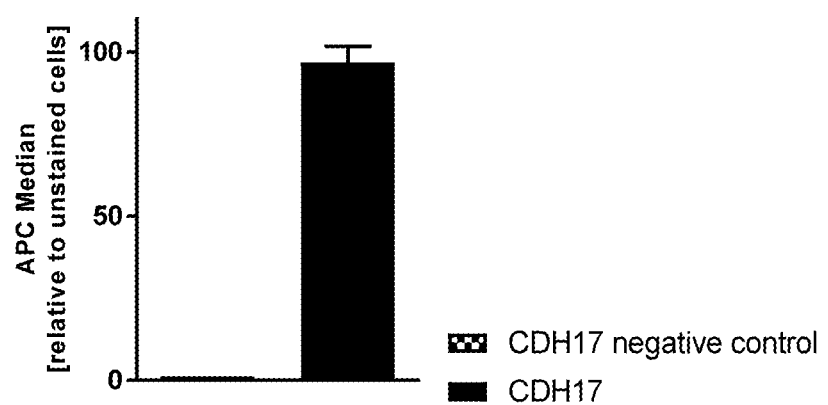
FIG. 13: Analysis of the protein surface expression of CDH17 in Colo-205 cells using new CDH17 antibody molecules. Results are shown as the mean APC values relative to the controls samples containing only cells. Representative data of a duplicated experiment.

Example 12: Detection of CDH17 Surface Expression Using Newly Generated CDH17 antibodies. In FIG. 13 is shown how the newly generated anti-CDH17H2 antibody (comprising a VH of SEQ ID NO: 116 and a VL of SEQ ID NO: 117 and an IgG1 sequence of SEQ ID NO: 121) is able to detect CDH17 protein surface expression. FACS analysis was performed as described in Example 6. The newly generated anti-CDH17H2 antibody was used as primary antibody for detection, followed by a secondary antibody rabbit anti-mouse IgG PE (Dako, R0439). As control, a human IgG1 isotype control APC (Biolegend, 409306) was used.

Example 13: Pharmaceutical Formulation for i.v. Administration

Any of the above binding molecules of the invention can be selected for the manufacture of a pharmaceutical formulation for i.v. application. An example of a suitable pharmaceutical formulation for the antibody of the invention is as follows.

A 10 mL vial contains 10 mg/mL of the binding molecule of the invention, in a buffer consisting of 10 mM citrate, pH 5.5, 207 mM sucrose, 25 mM lysine HCl and 0.02% polysorbate 20, and water for injection (WFI).

Example 14: ProtA Affinity Chromatography and Determination of Monomer Content by Analytical Size Exclusion Chromatography (aSEC)

Samples of various binding molecules described herein were captured from the harvested cell culture fluid by recombinant Protein-A affinity chromatography using MabSelect SuRe resin (GE Healthcare). Samples were eluted in an isocratic mode using 30 mM sodium acetate, pH 3.5 and the eluted samples were neutralized to pH 5.0 using 1% solution of 3M sodium acetate, pH 9.0.

aSEC was performed with Waters BEH200 column on a Waters UHPLC system. The mobile phase buffer was 50 mM sodium phosphate pH 6.8, 200 mM arginine, 0.05% sodium azide. For each run, 5-10 µg of sample was injected with a running flow rate at 0.5 ml/min Percentages of monomer content was determined and results for various binding molecules are shown in Table 4.

| Binding molecule | % monomer after protA |
|---|---|
| CDH17H2/TRv2 (SEQ ID NOs 212/218) | 98% |
| CDH17H2/TRv3 (SEQ ID NOs 213/218) | 99% |
| CDH17H2/TRv4 (SEQ ID NOs 214/218) | 96% |
| CDH17H2/TRv5 (SEQ ID NOs 215/218) | 96% |
| CDH17H2/TRv6 (SEQ ID NOs 216/218) | 97.7% |
| CDH17H2/TRv7 (SEQ ID NOs 217/218) | 98.3% |

SEQUENCE LISTING (272 sequences)

SEQ ID NO: 1 - protein, 10 aa, Artificial Sequence
  CDR
DYTFTSYDIN

SEQ ID NO: 2 - protein, 17 aa, Artificial Sequence
  CDR
WIDPGSGNTKYNEKFKG

SEQ ID NO: 3 - protein, 11 aa, Artificial Sequence
  CDR
KNYGGSYAFTY

SEQ ID NO: 4 - protein, 11 aa, Artificial Sequence
  CDR
KASQDVITAVA

SEQ ID NO: 5 - protein, 7 aa, Artificial Sequence
  CDR
WASTRHT

SEQ ID NO: 6 - protein, 9 aa, Artificial Sequence
  CDR
QQHYSTPWT

SEQ ID NO: 7 - protein, 10 aa, Artificial Sequence
  CDR
GYTFTEYIIH

SEQ ID NO: 8 - protein, 17 aa, Artificial Sequence
  CDR
WFYPGSGSIKYNEKFKD

SEQ ID NO: 9 - protein, 12 aa, Artificial Sequence
  CDR
HEEGGYSAWFPY

SEQ ID NO: 10 - protein, 11 aa, Artificial Sequence
  CDR
KASQDVSTAVA

SEQ ID NO: 11 - protein, 7 aa, Artificial Sequence
  CDR
WASTRHT

SEQ ID NO: 12 - protein, 9 aa, Artificial Sequence
  CDR
QQHYSTPYT

SEQ ID NO: 13 - protein, 11 aa, Artificial Sequence
  CDR
GYTFTDYYYLN

SEQ ID NO: 14 - protein, 17 aa, Artificial Sequence
  CDR
YIYPNNGDTSYNQKFKG

SEQ ID NO: 15 - protein, 10 aa, Artificial Sequence
  CDR
GSNWIWYFDV

SEQ ID NO: 16 - protein, 16 aa, Artificial Sequence
  CDR
RSSQSIVHSNGDTYLD

SEQ ID NO: 17 - protein, 7 aa, Artificial Sequence
  CDR
KVSNRFS

SEQ ID NO: 18 - protein, 9 aa, Artificial Sequence
  CDR
FRGSHIPPT

SEQ ID NO: 19 - protein, 10 aa, Artificial Sequence
  CDR
GYSFTDYYIN

SEQ ID NO: 20 - protein, 17 aa, Artificial Sequence
  CDR
KIGPGSGNTYYNEKFEG

SEQ ID NO: 21 - protein, 6 aa, Artificial Sequence
  CDR
TGPFAY

SEQ ID NO: 22 - protein, 11 aa, Artificial Sequence
  CDR
KASQNVGNNVA

SEQ ID NO: 23 - protein, 7 aa, Artificial Sequence
  CDR
YASNRYT

SEQ ID NO: 24 - protein, 9 aa, Artificial Sequence
  CDR
QQHYSSPLT

SEQ ID NO: 25 - protein, 12 aa, Artificial Sequence
  CDR
GFSLSTSGMGVS

SEQ ID NO: 26 - protein, 16 aa, Artificial Sequence
  CDR
HIYWDDDKRYNPSLKS

SEQ ID NO: 27 - protein, 8 aa, Artificial Sequence
  CDR
RRLGPFAY

SEQ ID NO: 28 - protein, 11 aa, Artificial Sequence
  CDR
KASQDVGTAVA

SEQ ID NO: 29 - protein, 7 aa, Artificial Sequence
  CDR
WASTRHT

SEQ ID NO: 30 - protein, 9 aa, Artificial Sequence
  CDR
QQYSSYPYT

SEQ ID NO: 31 - protein, 11 aa, Artificial Sequence
  CDR
GYTFTDYYYMN

SEQ ID NO: 32 - protein, 17 aa, Artificial Sequence
  CDR
YIYPNNGGTRYNQKFKG

SEQ ID NO: 33 - protein, 10 aa, Artificial Sequence
  CDR
GGNWNWYFDV

SEQ ID NO: 34 - protein, 16 aa, Artificial Sequence
  CDR
RSSQNIVHSNGNTYLD

SEQ ID NO: 35 - protein, 7 aa, Artificial Sequence
  CDR
KVSNRFS

SEQ ID NO: 36 - protein, 9 aa, Artificial Sequence
  CDR
FQGSHVPPT

SEQ ID NO: 37 - protein, 10 aa, Artificial Sequence
  CDR
GYTFTEYIIH

SEQ ID NO: 38 - protein, 17 aa, Artificial Sequence
  CDR
WFYPGSGNIKYNEKFKD

SEQ ID NO: 39 - protein, 10 aa, Artificial Sequence
  CDR
HEGGSNFFPY

SEQ ID NO: 40 - protein, 11 aa, Artificial Sequence
  CDR
KASQDVSNAVA

SEQ ID NO: 41 - protein, 7 aa, Artificial Sequence
  CDR
WASTRHN

SEQ ID NO: 42 - protein, 9 aa, Artificial Sequence
  CDR
QQHYRTPYT

SEQ ID NO: 43 - protein, 10 aa, Artificial Sequence
  CDR
GFTFDDYGMS

SEQ ID NO: 44 - protein, 17 aa, Artificial Sequence
  CDR
GINWNGGSTGYADSVKG

SEQ ID NO: 45 - protein, 17 aa, Artificial Sequence
  CDR
GINWSGGSTGYADSVKG

SEQ ID NO: 46 - protein, 17 aa, Artificial Sequence
  CDR
GINWAGGSTGYADSVKG

SEQ ID NO: 47 - protein, 17 aa, Artificial Sequence
  CDR
GINWTGGSTGYADSVKG

SEQ ID NO: 48 - protein, 12 aa, Artificial Sequence
  CDR
ILGAGRGWYFDL

SEQ ID NO: 49 - protein, 11 aa, Artificial Sequence
  CDR
QGDSLRSYYAS

SEQ ID NO: 50 - protein, 7 aa, Artificial Sequence
  CDR
GKNNRPS

SEQ ID NO: 51 - protein, 7 aa, Artificial Sequence
  CDR
GKTNRPS

SEQ ID NO: 52 - protein, 7 aa, Artificial Sequence
  CDR
GKANRPS

SEQ ID NO: 53 - protein, 7 aa, Artificial Sequence
  CDR
GKDNRPS

SEQ ID NO: 54 - protein, 11 aa, Artificial Sequence
  CDR
NSRDSSGNHVV

SEQ ID NO: 55 - protein, 11 aa, Artificial Sequence
  CDR
NSRDSSGTHVV

SEQ ID NO: 56 - protein, 11 aa, Artificial Sequence
  CDR
NSRDSSGAHVV

SEQ ID NO: 57 - protein, 11 aa, Artificial Sequence
  CDR
NSRDSSGDHVV

SEQ ID NO: 58 - protein, 10 aa, Artificial Sequence
  CDR
GYTLTDHTIH

SEQ ID NO: 59 - protein, 17 aa, Artificial Sequence
  CDR
YIYPRDDITQYNENFKA

SEQ ID NO: 60 - protein, 14 aa, Artificial Sequence
  CDR
WSWHFGSNYYGLDY

SEQ ID NO: 61 - protein, 11 aa, Artificial Sequence
  CDR
KASQNVGTALA

SEQ ID NO: 62 - protein, 7 aa, Artificial Sequence
  CDR
SASNRFT

SEQ ID NO: 63 - protein, 9 aa, Artificial Sequence
  CDR
QQYSTYPLT

SEQ ID NO: 64 - protein, 10 aa, Artificial Sequence
  CDR
GYTFTDHTIH

SEQ ID NO: 65 - protein, 17 aa, Artificial Sequence
  CDR
YIYPRDAITKYNEKFKG

SEQ ID NO: 66 - protein, 14 aa, Artificial Sequence
  CDR
WGYYFGSTSYYFDF

SEQ ID NO: 67 - protein, 11 aa, Artificial Sequence
  CDR
KASQNVGTGVV

SEQ ID NO: 68 - protein, 7 aa, Artificial Sequence
  CDR
SPSNRYT

SEQ ID NO: 69 - protein, 9 aa, Artificial Sequence
  CDR
QQYSTYPWT

SEQ ID NO: 70 - protein, 10 aa, Artificial Sequence
  CDR
GYTFTDHTIH

SEQ ID NO: 71 - protein, 17 aa, Artificial Sequence
  CDR
YIYPRDVITQYNEKFKG

SEQ ID NO: 72 - protein, 14 aa, Artificial Sequence
  CDR
WGYFYGSRSYYFDY

SEQ ID NO: 73 - protein, 11 aa, Artificial Sequence
  CDR
KASQNVGTAVA

SEQ ID NO: 74 - protein, 7 aa, Artificial Sequence
  CDR
SASNRYT

SEQ ID NO: 75 - protein, 9 aa, Artificial Sequence
  CDR
QQYSSYPWT

SEQ ID NO: 76 - protein, 10 aa, Artificial Sequence
  CDR
GYTLTDHTIH

SEQ ID NO: 77 - protein, 17 aa, Artificial Sequence
  CDR
YIYPRDGITGYNEKFKG

SEQ ID NO: 78 - protein, 14 aa, Artificial Sequence
  CDR
WGYSYRNYAYYYDY

SEQ ID NO: 79 - protein, 17 aa, Artificial Sequence
  CDR
KSSQSLLHSSNQKNYLA

SEQ ID NO: 80 - protein, 7 aa, Artificial Sequence
  CDR
WASTRES

SEQ ID NO: 81 - protein, 9 aa, Artificial Sequence
  CDR
QQYYSYPWT

SEQ ID NO: 82 - protein, 120 aa, Artificial Sequence
  Variable domain
QVQLQQSGAELVKPGASVKLSCKAFDYTFTSYDINWVKQRPGQGLEWIGWIDPGSGNTKYNEKFKGKATLTADKSSSTAYMHLSSLTSEDSAVYFCARKNYGGSYAFTYWGQGTLVTVSA

SEQ ID NO: 83 - protein, 107 aa, Artificial Sequence
  Variable domain
DIVMTQSHKFMSTSVGDRVSITCKASQDVITAVAWYQQKPGQSPKLLIYWASTRHTGVPDRFTGTGSGTDYTLTISSVQAEDLALYYCQQHYSTPWTFGGGTKLEIK

SEQ ID NO: 84 - protein, 121 aa, Artificial Sequence
  Variable domain
KVQLQQSGAELVKTGTSVKLSCKASGYTFTEYIIHWVKQRSGQGLEWIGWFYPGSGSIKYNEKFKDKATLTADKSSSTVYMELSRLTSEDSAVYFCARHEEGGYSAWFPYWGQGTLVTVSA

SEQ ID NO: 85 - protein, 107 aa, Artificial Sequence
  Variable domain
DIVMTQSHKFMSTSVGDRVSITCKASQDVSTAVAWYQQKPGQSPKVLIYWASTRHTGVPDRFTGSGSGTDYILTISSVQAEDLALYYCQQHYSTPYTFGGGTKLEIK

SEQ ID NO: 86 - protein, 120 aa, Artificial Sequence
  Variable domain
EVQLQQSGPELVKPGASVKISCKASGYTFTDYYYLNWVKQSHGKSLEWIGYIYPNNGDTSYNQKFKGKTTLTVDKSSSTAYMEFRSLTSEDSAVYYCTRGSNWIWYFDVWGTGTTVTVSS

SEQ ID NO: 87 - protein, 112 aa, Artificial Sequence
  Variable domain
DVLMTQTPLSLPVSLGDQASISCRSSQSIVHSNGDTYLDWYLQKPGQSPKLLIYKVSNRFSGVPDRFSGSGSGTDFTLKISRVVAEDLGVYYCFRGSHIPPTFGAGTKLELK

SEQ ID NO: 88 - protein, 115 aa, Artificial Sequence
  Variable domain
QVQLKQSGAELVKPGASVKISCKASGYSFTDYYINWVKQRPGQGLEWIGKIGPGSGNTYYNEKFEGKATLTADKSSSTAYMQLSSLTSEDSAVYFCASTGPFAYWGQGTLVTWSA

SEQ ID NO: 89 - protein, 107 aa, Artificial Sequence
  Variable domain
SIVMTQTPKFLPVSAGDRVTMTCKASQNVGNNVAWYQQKPGQSPKLLISYASNRYTGVPDRFTGSGSGTDFTFTISSVQVEDLAVYFCQQHYSSPLTFGAGTKLELK

SEQ ID NO: 90 - protein, 118 aa, Artificial Sequence
  Variable domain
QVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRRLGPFAYWGQGTLVTVSA

SEQ ID NO: 91 - protein, 107 aa, Artificial Sequence
  Variable domain
DIVMTQSHKFMSTSVGDRVSITCKASQDVGTAVAWYQQKPGQSPKLLIYWASTRHTGVPDRFTGSGSGTDFTLTISNVQSEDLADYFCQQYSSYPYTFGGGTKLEIK

SEQ ID NO: 92 - protein, 120 aa, Artificial Sequence
  Variable domain
EVQLQQSGPELVKPGASVKISCKASGYTFTDYYYMNWVKQSHGKSLEWIGYIYPNNGGTRYNQKFKGKATLTVDKSSSTAYMELRSLTSEDSAVYYCARGGNWNWYFDVWGTGTTVTVSS

SEQ ID NO: 93 - protein, 112 aa, Artificial Sequence
  Variable domain
DVLMTQTPLSLPVSLGDQASISCRSSQNIVHSNGNTYLDWYLQKPGQSPKLLIYKVSNRFSGVPDRFSGSGSGTDFTLKISRVEAEDLGVYYCFQGSHVPPTFGAGTKLELK

SEQ ID NO: 94 - protein, 119 aa, Artificial Sequence
  Variable domain
KVQLQQSGAELVKPGASVKLSCKASGYTFTEYIIHWVKQKSGQGLEWIGWFYPGSGNIKYNEKFKDKATLTADKSSSTVYMELSRLTSEDSAVYFCTRHEGGSNFFPYWGQGTLVTVSA

SEQ ID NO: 95 - protein, 107 aa, Artificial Sequence
  Variable domain
DIVMTQSHKFMSTSVGDRVSITCKASQDVSNAVAWYQQKPGQSPKLLIYWASTRHNGVPDRFTGSGSGTDYILTISSVQAEDLALYYCQQHYRTPYTFGGGTKLEIK

SEQ ID NO: 96 - protein, 121 aa, Artificial Sequence
  Variable domain
EVQLVQSGGGVERPGGSLRLSCAASGFTFDDYGMSWVRQAPGKGLEWVSGINWNGGSTGYADSVKGRVTISRDNAKNSLYLQMNSLRAEDTAVYYCAKILGAGRGWYFDLWGKGTTVTVSS

SEQ ID NO: 97 - protein, 108 aa, Artificial Sequence
  Variable domain
DIELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVL

SEQ ID NO: 98 - protein, 121 aa, Artificial Sequence; identical to SEQ ID NO: 96
  Variable domain

SEQ ID NO: 99 - protein, 108 aa, Artificial Sequence
  Variable domain
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVL

SEQ ID NO: 100 - protein, 121 aa, Artificial Sequence
  Variable domain
EVQLVQSGGGVERPGGSLRLSCAASGFTFDDYGMSWVRQAPGKGLEWVSGINWSGGSTGYADSVKGRVTISRDNAKNSLYLQMNSLRAEDTAVYYCAKILGAGRGWYFDLWGKGTTVTVSS

SEQ ID NO: 101 - protein, 108 aa, Artificial Sequence
  Variable domain
SSELTQDPAVSVALGQTVRITCQGDSLRSYYASWYQQKPGQAPVLVIYGKTNRPSGIPDRFSGSSSGNTASLTITGAQAEDEADYYCNSRDSSGTHVVFGGGTKLTVL

SEQ ID NO: 102 - protein, 121 aa, Artificial Sequence; identical to SEQ ID NO: 100
  Variable domain

SEQ ID NO: 103 - protein, 108 aa, Artificial Sequence
  Variable domain
SSELTQDPAVSVALGQTVRITCQGDSLRSYYASWYQQKPGQAPVLVIYGKANRPSGIPDRFSGSSSGNTASLTITGAQAEDEADYYCNSRDSSGAHVVFGGGTKLTVL

SEQ ID NO: 104 - protein, 121 aa, Artificial Sequence; identical to SEQ ID NO: 100
  Variable domain

SEQ ID NO: 105 - protein, 108 aa, Artificial Sequence; identical to SEQ ID NO: 99
  Variable domain

SEQ ID NO: 106 - protein, 121 aa, Artificial Sequence
  Variable domain
EVQLVQSGGGVERPGGSLRLSCAASGFTFDDYGMSWVRQAPGKGLEWVSGINWAGGSTGYADSVKGRVTISRDNAKNSLYLQMNSLRAEDTAVYYCAKILGAGRGWYFDLWGKGTTVTVSS

SEQ ID NO: 107 - protein, 108 aa, Artificial Sequence
  Variable domain
SSELTQDPAVSVALGQTVRITCQGDSLRSYYASWYQQKPGQAPVLVIYGKTNRPSGIPDRFSGSSSGNTASLTITGAQAEDEADYYCNSRDSSGDHVVFGGGTKLTVL

SEQ ID NO: 108 - protein, 121 aa, Artificial Sequence
  Variable domain
EVQLVQSGGGVERPGGSLRLSCAASGFTFDDYGMSWVRQAPGKGLEWVSGINWTGGSTGYADSVKGRVTISRDNAKNSLYLQMNSLRAEDTAVYYCAKILGAGRGWYFDLWGKGTTVTVSS

SEQ ID NO: 109 - protein, 108 aa, Artificial Sequence
  Variable domain
SSELTQDPAVSVALGQTVRITCQGDSLRSYYASWYQQKPGQAPVLVIYGKDNRPSGIPDRFSGSSSGNTASLTITGAQAEDEADYYCNSRDSSGDHVVFGGGTKLTVL

SEQ ID NO: 110 - protein, 123 aa, Artificial Sequence
  Variable domain
QVQLQQSDAELVKPGASVKISCKVSGYTLTDHTIHWMKQRPDQGLDWIGYIYPRDDITQYNENFKAKSTLTADKSSSTAYMQLNSLTSEDSAVYFCARWSWHFGSNYYGLDYWGQGTSVTVSS

SEQ ID NO: 111 - protein, 107 aa, Artificial Sequence
  Variable domain
DIVMTQSQTFMSTTVGDRVSITCKASQNVGTALAWYQQKPRQSPKLLIYSASNRFTGVPDRFTGSGSGTDFTLTISNMRSEDLADYVCQQYSTYPLTFGSGTKLEIR

SEQ ID NO: 112 - protein, 123 aa, Artificial Sequence
  Variable domain
QVQLQQSDAELVKPGASVKISCKVSGYTFTDHTIHWMKQRPEQGLEWIGYIYPRDAITKYNEKFKGKATLTADKSSSTAYMQLNSLTSEDSAVYFCARWGYYFGSTSYYFDFWGQGTTLTVSS

SEQ ID NO: 113 - protein, 107 aa, Artificial Sequence
  Variable domain
DIVMTQSQKFMSTTVGDRVSITCKASQNVGTGVVWYQQRPGQSPKLLIYSPSNRYTGVPDRFTGSGSGTDFTLTITNIQSEDLADYFCQQYSTYPWTFGGGTKLEIK

SEQ ID NO: 114 - protein, 123 aa, Artificial Sequence
  Variable domain
QVQLQQSDAELVKPGASVKISCKVSGYTFTDHTIHWMKQRPEQGLEWIGYIYPRDVITQYNEKFKGKATLTADKSSSTAYMQLNSLTSEDSAVYLCARWGYFYGSRSYYFDYWGQGTTLTVSS

SEQ ID NO: 115 - protein, 107 aa, Artificial Sequence
  Variable domain
DIVMTQSQKFMSTTVGDRVNITCKASQNVGTAVAWYQQKPGQSPKLLIYSASNRYTGVPDRFTGSGSGTDFTLTITNMQSKDLADYFCQQYSSYPWTFGGGTKLEIK

SEQ ID NO: 116 - protein, 123 aa, Artificial Sequence
  Variable domain
QVQLVQSGAEVKKPGSSVKVSCKVSGYTFTDHTIHWMKQRPGQGLEWIGYIYPRDVITQYNEKFKGKVTLTADKSTSTAYMELSSLRSEDTAVYLCARWGYFYGSRSYYFDYWGQGTTVTVSS

SEQ ID NO: 117 - protein, 107 aa, Artificial Sequence
  Variable domain
DIQMTQSQSSLSASVGDRVGITCKASQNVGTAVAWYQQKPGKAPKLLIYSASNRYTGVPSRFSGSGSGTDFTLTISSLQPKDFATYFCQQYSSYPWTFGQGTKLEIK

SEQ ID NO: 118 - protein, 123 aa, Artificial Sequence
  Variable domain
EVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSS

SEQ ID NO: 119 - protein, 113 aa, Artificial Sequence
  Variable domain
DIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIK

SEQ ID NO: 120 - protein, 330 aa, Artificial Sequence
  Constant domain
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 121 - protein, 329 aa, Artificial Sequence
  Constant domain
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 122 - protein, 327 aa, Artificial Sequence
  Constant domain
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 123 - protein, 107 aa, Artificial Sequence [sequence omitted]

SEQ ID NO: 124 - protein, 251 aa, Artificial Sequence
  scFv
DIELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGQGGGGSGGGGSGGGGSGGGGSEVQLVQSGGGVERPGGSLRLSCAASGFTFDDYGMSWVRQAPGKGLEWVSGINWNGGSTGYADSVKGRVTISRDNAKNSLYLQMNSLRAEDTAVYYCAKILGAGRGWYFDLWGKGTTVTVSS

SEQ ID NO: 125 - protein, 249 aa, Artificial Sequence
  scFv
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGGGGSGGGGSGGGGSGGGGSEVQLVQSGGGVERPGGSLRLSCAASGFTFDDYGMSWVRQAPGKGLEWVSGINWNGGSTGYADSVKGRVTISRDNAKNSLYLQMNSLRAEDTAVYYCAKILGAGRGWYFDLWGKGTTVTVSS

SEQ ID NO: 126 - protein, 249 aa, Artificial Sequence
  scFv
SSELTQDPAVSVALGQTVRITCQGDSLRSYYASWYQQKPGQAPVLVIYGKTNRPSGIPDRFSGSSSGNTASLTITGAQAEDEADYYCNSRDSSGTHVVFGGGTKLTVLGGGGSGGGGSGGGGSGGGGSEVQLVQSGGGVERPGGSLRLSCAASGFTFDDYGMSWVRQAPGKGLEWVSGINWSGGSTGYADSVKGRVTISRDNAKNSLYLQMNSLRAEDTAVYYCAKILGAGRGWYFDLWGKGTTVTVSS

SEQ ID NO: 127 - protein, 249 aa, Artificial Sequence
  scFv
SSELTQDPAVSVALGQTVRITCQGDSLRSYYASWYQQKPGQAPVLVIYGKANRPSGIPDRFSGSSSGNTASLTITGAQAEDEADYYCNSRDSSGAHVVFGGGTKLTVLGGGGSGGGGSGGGGSGGGGSEVQLVQSGGGVERPGGSLRLSCAASGFTFDDYGMSWVRQAPGKGLEWVSGINWSGGSTGYADSVKGRVTISRDNAKNSLYLQMNSLRAEDTAVYYCAKILGAGRGWYFDLWGKGTTVTVSS

SEQ ID NO: 128 - protein, 249 aa, Artificial Sequence
  scFv
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGGGGSGGGGSGGGGSGGGGSEVQLVQSGGGVERPGGSLRLSCAASGFTFDDYGMSWVRQAPGKGLEWVSGINWSGGSTGYADSVKGRVTISRDNAKNSLYLQMNSLRAEDTAVYYCAKILGAGRGWYFDLWGKGTTVTVSS

SEQ ID NO: 129 - protein, 249 aa, Artificial Sequence
  scFv
SSELTQDPAVSVALGQTVRITCQGDSLRSYYASWYQQKPGQAPVLVIYGKTNRPSGIPDRFSGSSSGNTASLTITGAQAEDEADYYCNSRDSSGDHVVFGGGTKLTVLGGGGSGGGGSGGGGSGGGGSEVQLVQSGGGVERPGGSLRLSCAASGFTFDDYGMSWVRQAPGKGLEWVSGINWAGGSTGYADSVKGRVTISRDNAKNSLYLQMNSLRAEDTAVYYCAKILGAGRGWYFDLWGKGTTVTVSS

SEQ ID NO: 130 - protein, 249 aa, Artificial Sequence
  scFv
SSELTQDPAVSVALGQTVRITCQGDSLRSYYASWYQQKPGQAPVLVIYGKDNRPSGIPDRFSGSSSGNTASLTITGAQAEDEADYYCNSRDSSGDHVVFGGGTKLTVLGGGGSGGGGSGGGGSGGGGSEVQLVQSGGGVERPGGSLRLSCAASGFTFDDYGMSWVRQAPGKGLEWVSGINWTGGSTGYADSVKGRVTISRDNAKNSLYLQMNSLRAEDTAVYYCAKILGAGRGWYFDLWGKGTTVTVSS

SEQ ID NO: 131 - protein, 251 aa, Artificial Sequence
  scFv
EVQLVQSGGGVERPGGSLRLSCAASGFTFDDYGMSWVRQAPGKGLEWVSGINWNGGSTGYADSVKGRVTISRDNAKNSLYLQMNSLRAEDTAVYYCAKILGAGRGWYFDLWGKGTTVTVSSGGGGSGGGGSGGGGSGGGGSDIELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGQ

SEQ ID NO: 132 - protein, 251 aa, Artificial Sequence
  scFv
EVQLVQSGGGVERPGGSLRLSCAASGFTFDDYGMSWVRQAPGKCLEWVSGINWNGGSTGYADSVKGRVTISRDNAKNSLYLQMNSLRAEDTAVYYCAKILGAGRGWYFDLWGKGTTVTVSSGGGGSGGGGSGGGGSGGGGSDIELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGCGTKLTVLGQ

SEQ ID NO: 133 - protein, 251 aa, Artificial Sequence
  scFv
DIELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGCGTKLTVLGQGGGGSGGGGSGGGGSGGGGSEVQLVQSGGGVERPGGSLRLSCAASGFTFDDYGMSWVRQAPGKCLEWVSGINWNGGSTGYADSVKGRVTISRDNAKNSLYLQMNSLRAEDTAVYYCAKILGAGRGWYFDLWGKGTTVTVSS

SEQ ID NO: 134 - protein, 246 aa, Artificial Sequence
  scFv
DIVMTQSHKFMSTSVGDRVSITCKASQDVITAVAWYQQKPGQSPKLLIYWASTRHTGVPDRFTGTGSGTDYTLTISSVQAEDLALYYCQQHYSTPWTFGGGTKLEIKGGGGSGGGGSGGGGSGGGGSQVQLQQSGAELVKPGASVKLSCKAFDYTFTSYDINWVKQRPGQGLEWIGWIDPGSGNTKYNEKFKGKATLTADKSSSTAYMHLSSLTSEDSAVYFCARKNYGGSYAFTYWGQGTLVTVA

SEQ ID NO: 135 - protein, 248 aa, Artificial Sequence
  scFv
DIVMTQSHKFMSTSVGDRVSITCKASQDVSTAVAWYQQKPGQSPKVLIYWASTRHTGVPDRFTGSGSGTDYILTISSVQAEDLALYYCQQHYSTPYTFGGGTKLEIKGGGGSGGGGSGGGGSGGGGSKVQLQQSGAELVKTGTSVKLSCKASGYTFTEYIIHWVKQRSGQGLEWIGWFYPGSGSIKYNEKFKDKATLTADKSSSTVYMELSRLTSEDSAVYFCARHEEGGYSAWFPYWGQGTLVTVSA

SEQ ID NO: 136 - protein, 251 aa, Artificial Sequence
  scFv
DVLMTQTPLSLPVSLGDQASISCRSSQSIVHSNGDTYLDWYLQKPGQSPKLLIYKVSNRFSGVPDRFSGSGSGTDFTLKISRVVAEDLGVYYCFRGSHIPPTFGAGTKLEKGGGGSGGGGSGGGGSGGGGSEVQLQQSGPELVKPGASVKISCKASGYTFTDYYYLNWVKQSHGKSLEWIGYIYPNNGDTSYNQKFKGKTTLTVDKSSSTAYMEFRSLTSEDSAVYYCTRGSNWIWYFDVWGTGTTVTVSS

SEQ ID NO: 137 - protein, 241 aa, Artificial Sequence
  scFv
SIVMTQTPKFLPVSAGDRVTMTCKASQNVGNNVAWYQQKPGQSPKLLISYASNRYTGVPDRFTGSGSGTDFFTISSVQVEDLAVYFCQQHYSSPLTFGAGTKLELKGGGGSGGGGSGGGGSGGGGSQVQLKQSGAELVKPGASVKISCKASGYSFTDYYINWVKQRPGQGLEWIGKIGPGSGNTYYNEKFEGKATLTADKSSSTAYMQLSSLTSEDSAVYFCASTGPFAYWGQGTLVTWSA

SEQ ID NO: 138 - protein, 245 aa, Artificial Sequence
  scFv
DIVMTQSHKFMSTSVGDRVSITCKASQDVGTAVAWYQQKPGQSPKLLIYWASTRHTGVPDRFTGSGSGTDFTLTISNVQSEDLADYFCQQYSSYPYTFGGGTKLEIKGGGGSGGGGSGGGGSGGGGSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRRLGPFAYWGQGTLVTVSA

SEQ ID NO: 139 - protein, 252 aa, Artificial Sequence
  scFv
DVLMTQTPLSLPVSLGDQASISCRSSQNIVHSNGNTYLDWYLQKPGQSPKLLIYKVSNRFSGVPDRFSGSGSGTDFTLKISRVEAEDLGVYYCFQGSHVPPTFGAGTKLELKGGGGSGGGGSGGGGSGGGGSEVQLQQSGPELVKPGASVKISCKASGYTFTDYYYMNWVKQSHGKSLEWIGYIYPNNGGTRYNQKFKGKATLTVDKSSSTAYMELRSLTSEDSAVYYCARGGNWNWYFDVWGTGTTVTVSS

SEQ ID NO: 140 - protein, 246 aa, Artificial Sequence
  scFv
DIVMTQSHKFMSTSVGDRVSITCKASQDVSNAVAWYQQKPGQSPKLLIYWASTRHNGVPDRFTGSGSGTDYILTISSVQAEDLALYYCQQHYRTPYTFGGGTKLEIKGGGGSGGGGSGGGGSGGGGSKVQLQQSGAELVKPGASVKLSCKASGYTFTEYIIHWVKQKSGQGLEWIGWFYPGSGNIKYNEKFKDKATLTADKSSSTVYMELSRLTSEDSAVYFCTRHEGGSNFFPYWGQGTLVTVSA

SEQ ID NO: 141 - protein, 6 aa, Artificial Sequence
  Linker
GGSGGS

SEQ ID NO: 142 - protein, 10 aa, Artificial Sequence
  Linker
GGGGSGGGGS

SEQ ID NO: 143 - protein, 20 aa, Artificial Sequence
  Linker
GGGGSGGGGSGGGGSGGGGS

SEQ ID NO: 144 - protein, 4 aa, Artificial Sequence
  Linker
GGGS

SEQ ID NO: 145 - protein, 710 aa, Artificial Sequence
  Heavy chain
EVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGSGGSDIELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGQGGGGSGGGGSGGGGSGGGGSEVQLVQSGGGVERPGGSLRLSCAASGFTFDDYGMSWVRQAPGKGLEWVSGINWNGGSTGYADSVKGRVTISRDNAKNSLYLQMNSLRAEDTAVYYCAKILGAGRGWYFDLWGKGTTVTVSS

SEQ ID NO: 146 - protein, 220 aa, Artificial Sequence
  Light chain
DIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 147 - protein, 709 aa, Artificial Sequence
  Heavy chain
EVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDIELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGQGGGGSGGGGSGGGGSGGGGSEVQLVQSGGGVERPGGSLRLSCAASGFTFDDYGMSWVRQAPGKGLEWVSGINWNGGSTGYADSVKGRVTISRDNAKNSLYLQMNSLRAEDTAVYYCAKILGAGRGWYFDLWGKGTTVTVSS

SEQ ID NO: 148 - protein, 220 aa, Artificial Sequence; identical to SEQ ID NO: 146
  Light chain

SEQ ID NO: 149 - protein, 707 aa, Artificial Sequence
  Heavy chain
EVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGGGGSGGGGSGGGGSGGGGSEVQLVQSGGGVERPGGSLRLSCAASGFTFDDYGMSWVRQAPGKGLEWVSGINWNGGSTGYADSVKGRVTISRDNAKNSLYLQMNSLRAEDTAVYYCAKILGAGRGWYFDLWGKGTTVTVSS

SEQ ID NO: 150 - protein, 220 aa, Artificial Sequence; identical to SEQ ID NO: 146
  Light chain

SEQ ID NO: 151 - protein, 705 aa, Artificial Sequence
  Heavy chain
EVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGSGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGGGGSGGGGSGGGGSGGGGSEVQLVQSGGGVERPGGSLRLSCAASGFTFDDYGMSWVRQAPGKGLEWVSGINWNGGSTGYADSVKGRVTISRDNAKNSLYLQMNSLRAEDTAVYYCAKILGAGRGWYFDLWGKGTTVTVSS

SEQ ID NO: 152 - protein, 220 aa, Artificial Sequence; identical to SEQ ID NO: 146
  Light chain

SEQ ID NO: 153 - protein, 709 aa, Artificial Sequence
  Heavy chain
EVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSEVQLVQSGGGVERPGGSLRLSCAASGFTFDDYGMSWVRQAPGKGLEWVSGINWNGGSTGYADSVKGRVTISRDNAKNSLYLQMNSLRAEDTAVYYCAKILGAGRGWYFDLWGKGTTVTVSSGGGGSGGGGSGGGGSGGGGSDIELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGQ

SEQ ID NO: 154 - protein, 220 aa, Artificial Sequence; identical to SEQ ID NO: 146
  Light chain

SEQ ID NO: 155 - protein, 709 aa, Artificial Sequence
  Heavy chain
EVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSEVQLVQSGGGVERPGGSLRLSCAASGFTFDDYGMSWVRQAPGKCLEWVSGINWNGGSTGYADSVKGRVTISRDNAKNSLYLQMNSLRAEDTAVYYCAKILGAGRGWYFDLWGKGTTVTVSSGGGGSGGGGSGGGGSGGGGSDIELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGCGTKLTVLGQ

SEQ ID NO: 156 - protein, 220 aa, Artificial Sequence; identical to SEQ ID NO: 146
  Light chain

SEQ ID NO: 157 - protein, 709 aa, Artificial Sequence
  Heavy chain
EVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDIELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGCGTKLTVLGQGGGGSGGGGSGGGGSGGGGSEVQLVQSGGGVERPGGSLRLSCAASGFTFDDYGMSWVRQAPGKCLEWVSGINWNGGSTGYADSVKGRVTISRDNAKNSLYLQMNSLRAEDTAVYYCAKILGAGRGWYFDLWGKGTTVTVSS

SEQ ID NO: 158 - protein, 220 aa, Artificial Sequence; identical to SEQ ID NO: 146
  Light chain

SEQ ID NO: 159 - protein, 704 aa, Artificial Sequence
  Heavy chain
QVQLQQSDAELVKPGASVKISCKVSGYTLTDHTIHWMKQRPDQGLDWIGYIYPRDDITQYNENFKAKSTLTADKSSSTAYMQLNSLTSEDSAVYFCARWSWHFGSNYYGLDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDIVMTQSHKFMSTSVGDRVSITCKASQDVITAVAWYQQKPGQSPKLLIYWASTRHTGVPDRFTGTGSGTDYTLTISSVQAEDLALYYCQQHYSTPWTFGGGTKLEIKGGGGSGGGGSGGGGSGGGGSQVQLQQSGAELVKPGASVKLSCKAFDYTFTSYDINWVKQRPGQGLEWIGWIDPGSGNTKYNEKFKGKATLTADKSSSTAYMHLSSLTSEDSAVYFCARKNYGGSYAFTYWGQGTLVTVA

SEQ ID NO: 160 - protein, 706 aa, Artificial Sequence
  Heavy chain
QVQLQQSDAELVKPGASVKISCKVSGYTLTDHTIHWMKQRPDQGLDWIGYIYPRDDITQYNENFKAKSTLTADKSSSTAYMQLNSLTSEDSAVYFCARWSWHFGSNYYGLDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDIVMTQSHKFMSTSVGDRVSITCKASQDVSTAVAWYQQKPGQSPKVLIYWASTRHTGVPDRFTGSGSGTDYILTISSVQAEDLALYYCQQHYSTPYTFGGGTKLEIKGGGGSGGGGSGGGGSGGGGSKVQLQQSGAELVKTGTSVKLSCKASGYTFTEYIIHWVKQRSGQGLEWIGWFYPGSGSIKYNEKFKDKATLTADKSSSTVYMELSRLTSEDSAVYFCARHEEGGYSAWFPYWGQGTLVTVSA

SEQ ID NO: 161 - protein, 709 aa, Artificial Sequence
  Heavy chain
QVQLQQSDAELVKPGASVKISCKVSGYTLTDHTIHWMKQRPDQGLDWIGYIYPRDDITQYNENFKAKSTLTADKSSSTAYMQLNSLTSEDSAVYFCARWSWHFGSNYYGLDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDVLMTQTPLSLPVSLGDQASISCRSSQSIVHSNGDTYLDWYLQKPGQSPKLLIYKVSNRFSGVPDRFSGSGSGTDFTLKISRVVAEDLGVYYCFRGSHIPPTFGAGTKLEKGGGGSGGGGSGGGGSGGGGSEVQLQQSGPELVKPGASVKISCKASGYTFTDYYYLNWVKQSHGKSLEWIGYIYPNNGDTSYNQKFKGKTTLTVDKSSSTAYMEFRSLTSEDSAVYYCTRGSNWIWYFDVWGTGTTVTVSS

SEQ ID NO: 162 - protein, 699 aa, Artificial Sequence
  Heavy chain
QVQLQQSDAELVKPGASVKISCKVSGYTLTDHTIHWMKQRPDQGLDWIGYIYPRDDITQYNENFKAKSTLTADKSSSTAYMQLNSLTSEDSAVYFCARWSWHFGSNYYGLDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSSIVMTQTPKFLPVSAGDRVTMTCKASQNVGNNVAWYQQKPGQSPKLLISYASNRYTGVPDRFTGSGSGTDFFTISSVQVEDLAVYFCQQHYSSPLTFGAGTKLELKGGGGSGGGGSGGGGSGGGGSQVQLKQSGAELVKPGASVKISCKASGYSFTDYYINWVKQRPGQGLEWIGKIGPGSGNTYYNEKFEGKATLTADKSSSTAYMQLSSLTSEDSAVYFCASTGPFAYWGQGTLVTWSA

SEQ ID NO: 163 - protein, 703 aa, Artificial Sequence
  Heavy chain
QVQLQQSDAELVKPGASVKISCKVSGYTLTDHTIHWMKQRPDQGLDWIGYIYPRDDITQYNENFKAKSTLTADKSSSTAYMQLNSLTSEDSAVYFCARWSWHFGSNYYGLDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDIVMTQSHKFMSTSVGDRVSITCKASQDVGTAVAWYQQKPGQSPKLLIYWASTRHTGVPDRFTGSGSGTDFTLTISNVQSEDLADYFCQQYSSYPYTFGGGTKLEIKGGGGSGGGGSGGGGSGGGGSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRRLGPFAYWGQGTLVTVSA

SEQ ID NO: 164 - protein, 710 aa, Artificial Sequence
  Heavy chain
QVQLQQSDAELVKPGASVKISCKVSGYTLTDHTIHWMKQRPDQGLDWIGYIYPRDDITQYNENFKAKSTLTADKSSSTAYMQLNSLTSEDSAVYFCARWSWHFGSNYYGLDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDVLMTQTPLSLPVSLGDQASISCRSSQNIVHSNGNTYLDWYLQKPGQSPKLLIYKVSNRFSGVPDRFSGSGSGTDFTLKISRVEAEDLGVYYCFQGSHVPPTFGAGTKLELKGGGGSGGGGSGGGGSGGGGSEVQLQQSGPELVKPGASVKISCKASGYTFTDYYYMNWVKQSHGKSLEWIGYIYPNNGGTRYNQKFKGKATLTVDKSSSTAYMELRSLTSEDSAVYYCARGGNWNWYFDVWGTGTTVTVSS

SEQ ID NO: 165 - protein, 704 aa, Artificial Sequence
  Heavy chain
QVQLQQSDAELVKPGASVKISCKVSGYTLTDHTIHWMKQRPDQGLDWIGYIYPRDDITQYNENFKAKSTLTADKSSSTAYMQLNSLTSEDSAVYFCARWSWHFGSNYYGLDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDIVMTQSHKFMSTSVGDRVSITCKASQDVSNAVAWYQQKPGQSPKLLIYWASTRHNGVPDRFTGSGSGTDYILTISSVQAEDLALYYCQQHYRTPYTFGGGTKLEIKGGGGSGGGGSGGGGSGGGGSKVQLQQSGAELVKPGASVKLSCKASGYTFTEYIIHWVKQKSGQGLEWIGWFYPGSGNIKYNEKFKDKATLTADKSSSTVYMELSRLTSEDSAVYFCTRHEGGSNFFPYWGQGTLVTVSA

SEQ ID NO: 166 - protein, 707 aa, Artificial Sequence
  Heavy chain
QVQLQQSDAELVKPGASVKISCKVSGYTLTDHTIHWMKQRPDQGLDWIGYIYPRDDITQYNENFKAKSTLTADKSSSTAYMQLNSLTSEDSAVYFCARWSWHFGSNYYGLDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDIELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGCGTKLTVLGGGGSGGGGSGGGGSGGGGSEVQLVQSGGGVERPGGSLRLSCAASGFTFDDYGMSWVRQAPGKCLEWVSGINWNGGSTGYADSVKGRVTISRDNAKNSLYLQMNSLRAEDTAVYYCAKILGAGRGWYFDLWGKGTTVTVSS

SEQ ID NO: 167 - protein, 707 aa, Artificial Sequence
  Heavy chain
QVQLQQSDAELVKPGASVKISCKVSGYTLTDHTIHWMKQRPDQGLDWIGYIYPRDDITQYNENFKAKSTLTADKSSSTAYMQLNSLTSEDSAVYFCARWSWHFGSNYYGLDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGGGGSGGGGSGGGGSGGGGSEVQLVQSGGGVERPGGSLRLSCAASGFTFDDYGMSWVRQAPGKGLEWVSGINWNGGSTGYADSVKGRVTISRDNAKNSLYLQMNSLRAEDTAVYYCAKILGAGRGWYFDLWGKGTTVTVSS

SEQ ID NO: 168 - protein, 707 aa, Artificial Sequence
  Heavy chain
QVQLQQSDAELVKPGASVKISCKVSGYTLTDHTIHWMKQRPDQGLDWIGYIYPRDDITQYNENFKAKSTLTADKSSSTAYMQLNSLTSEDSAVYFCARWSWHFGSNYYGLDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSSSELTQDPAVSVALGQTVRITCQGDSLRSYYASWYQQKPGQAPVLVIYGKTNRPSGIPDRFSGSSSGNTASLTITGAQAEDEADYYCNSRDSSGTHVVFGGGTKLTVLGGGGSGGGGSGGGGSGGGGSEVQLVQSGGGVERPGGSLRLSCAASGFTFDDYGMSWVRQAPGKGLEWVSGINWSGGSTGYADSVKGRVTISRDNAKNSLYLQMNSLRAEDTAVYYCAKILGAGRGWYFDLWGKGTTVTVSS

SEQ ID NO: 169 - protein, 707 aa, Artificial Sequence
  Heavy chain
QVQLQQSDAELVKPGASVKISCKVSGYTLTDHTIHWMKQRPDQGLDWIGYIYPRDDITQYNENFKAKSTLTADKSSSTAYMQLNSLTSEDSAVYFCARWSWHFGSNYYGLDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSSSELTQDPAVSVALGQTVRITCQGDSLRSYYASWYQQKPGQAPVLVIYGKANRPSGIPDRFSGSSSGNTASLTITGAQAEDEADYYCNSRDSSGAHVVFGGGTKLTVLGGGGSGGGGSGGGGSGGGGSEVQLVQSGGGVERPGGSLRLSCAASGFTFDDYGMSWVRQAPGKGLEWVSGINWSGGSTGYADSVKGRVTISRDNAKNSLYLQMNSLRAEDTAVYYCAKILGAGRGWYFDLWGKGTTVTVSS

SEQ ID NO: 170 - protein, 707 aa, Artificial Sequence
  Heavy chain
QVQLQQSDAELVKPGASVKISCKVSGYTLTDHTIHWMKQRPDQGLDWIGYIYPRDDITQYNENFKAKSTLTADKSSSTAYMQLNSLTSEDSAVYFCARWSWHFGSNYYGLDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGGGGSGGGGSGGGGSGGGGSEVQLVQSGGGVERPGGSLRLSCAASGFTFDDYGMSWVRQAPGKGLEWVSGINWSGGSTGYADSVKGRVTISRDNAKNSLYLQMNSLRAEDTAVYYCAKILGAGRGWYFDLWGKGTTVTVSS

SEQ ID NO: 171 - protein, 707 aa, Artificial Sequence
  Heavy chain
QVQLQQSDAELVKPGASVKISCKVSGYTLTDHTIHWMKQRPDQGLDWIGYIYPRDDITQYNENFKAKSTLTADKSSSTAYMQLNSLTSEDSAVYFCARWSWHFGSNYYGLDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSSSELTQDPAVSVALGQTVRITCQGDSLRSYYASWYQQKPGQAPVLVIYGKTNRPSGIPDRFSGSSSGNTASLTITGAQAEDEADYYCNSRDSSGDHVVFGGGTKLTVLGGGGSGGGGSGGGGSGGGGSEVQLVQSGGGVERPGGSLRLSCAASGFTFDDYGMSWVRQAPGKGLEWVSGINWAGGSTGYADSVKGRVTISRDNAKNSLYLQMNSLRAEDTAVYYCAKILGAGRGWYFDLWGKGTTVTVSS

SEQ ID NO: 172 - protein, 707 aa, Artificial Sequence
  Heavy chain
QVQLQQSDAELVKPGASVKISCKVSGYTLTDHTIHWMKQRPDQGLDWIGYIYPRDDITQYNENFKAKSTLTADKSSSTAYMQLNSLTSEDSAVYFCARWSWHFGSNYYGLDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSSSELTQDPAVSVALGQTVRITCQGDSLRSYYASWYQQKPGQAPVLVIYGKDNRPSGIPDRFSGSSSGNTASLTITGAQAEDEADYYCNSRDSSGDHVVFGGGTKLTVLGGGGSGGGGSGGGGSGGGGSEVQLVQSGGGVERPGGSLRLSCAASGFTFDDYGMSWVRQAPGKGLEWVSGINWTGGSTGYADSVKGRVTISRDNAKNSLYLQMNSLRAEDTAVYYCAKILGAGRGWYFDLWGKGTTVTVSS

SEQ ID NO: 173 - protein, 214 aa, Artificial Sequence
  Light chain
DIVMTQSQTFMSTTVGDRVSITCKASQNVGTALAWYQQKPRQSPKLLIYSASNRFTGVPDRFTGSGSGTDFTLTISNMRSEDLADYVCQQYSTYPLTFGSGTKLEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 174 - protein, 704 aa, Artificial Sequence
  Heavy chain
QVQLQQSDAELVKPGASVKISCKVSGYTFTDHTIHWMKQRPEQGLEWIGYIYPRDAITKYNEKFKGKATLTADKSSSTAYMQLNSLTSEDSAVYFCARWGYYFGSTSYYFDFWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDIVMTQSHKFMSTSVGDRVSITCKASQDVITAVAWYQQKPGQSPKLLIYWASTRHTGVPDRFTGTGSGTDYTLTISSVQAEDLALYYCQQHYSTPWTFGGGTKLEIKGGGGSGGGGSGGGGSGGGGSQVQLQQSGAELVKPGASVKLSCKAFDYTFTSYDINWVKQRPGQGLEWIGWIDPGSGNTKYNEKFKGKATLTADKSSSTAYMHLSSLTSEDSAVYFCARKNYGGSYAFTYWGQGTLVTVA

SEQ ID NO: 175 - protein, 706 aa, Artificial Sequence
  Heavy chain
QVQLQQSDAELVKPGASVKISCKVSGYTFTDHTIHWMKQRPEQGLEWIGYIYPRDAITKYNEKFKGKATLTADKSSSTAYMQLNSLTSEDSAVYFCARWGYYFGSTSYYFDFWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDIVMTQSHKFMSTSVGDRVSITCKASQDVSTAVAWYQQKPGQSPKVLIYWASTRHTGVPDRFTGSGSGTDYILTISSVQAEDLALYYCQQHYSTPYTFGGGTKLEIKGGGGSGGGGSGGGGSGGGGSKVQLQQSGAELVKTGTSVKLSCKASGYTFTEYIIHWVKQRSGQGLEWIGWFYPGSGSIKYNEKFKDKATLTADKSSSTVYMELSRLTSEDSAVYFCARHEEGGYSAWFPYWGQGTLVTVSA

SEQ ID NO: 176 - protein, 709 aa, Artificial Sequence
  Heavy chain
QVQLQQSDAELVKPGASVKISCKVSGYTFTDHTIHWMKQRPEQGLEWIGYIYPRDAITKYNEKFKGKATLTADKSSSTAYMQLNSLTSEDSAVYFCARWGYYFGSTSYYFDFWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDVLMTQTPLSLPVSLGDQASISCRSSQSIVHSNGDTYLDWYLQKPGQSPKLLIYKVSNRFSGVPDRFSGSGSGTDFTLKISRVVAEDLGVYYCFRGSHIPPTFGAGTKLEKGGGGSGGGGSGGGGSGGGGSEVQLQQSGPELVKPGASVKISCKASGYTFTDYYYLNWVKQSHGKSLEWIGYIYPNNGDTSYNQKFKGKTTLTVDKSSSTAYMEFRSLTSEDSAVYYCTRGSNWIWYFDVWGTGTTVTVSS

SEQ ID NO: 177 - protein, 699 aa, Artificial Sequence
  Heavy chain
QVQLQQSDAELVKPGASVKISCKVSGYTFTDHTIHWMKQRPEQGLEWIGYIYPRDAITKYNEKFKGKATLTADKSSSTAYMQLNSLTSEDSAVYFCARWGYYFGSTSYYFDFWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSSIVMTQTPKFLPVSAGDRVTMTCKASQNVGNNVAWYQQKPGQSPKLLISYASNRYTGVPDRFTGSGSGTDFFTISSVQVEDLAVYFCQQHYSSPLTFGAGTKLELKGGGGSGGGGSGGGGSGGGGSQVQLKQSGAELVKPGASVKISCKASGYSFTDYYINWVKQRPGQGLEWIGKIGPGSGNTYYNEKFEGKATLTADKSSSTAYMQLSSLTSEDSAVYFCASTGPFAYWGQGTLVTWSA

SEQ ID NO: 178 - protein, 703 aa, Artificial Sequence
  Heavy chain
QVQLQQSDAELVKPGASVKISCKVSGYTFTDHTIHWMKQRPEQGLEWIGYIYPRDAITKYNEKFKGKATLTADKSSSTAYMQLNSLTSEDSAVYFCARWGYYFGSTSYYFDFWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDIVMTQSHKFMSTSVGDRVSITCKASQDVGTAVAWYQQKPGQSPKLLIYWASTRHTGVPDRFTGSGSGTDFTLTISNVQSEDLADYFCQQYSSYPYTFGGGTKLEIKGGGGSGGGGSGGGGSGGGGSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRRLGPFAYWGQGTLVTVSA

SEQ ID NO: 179 - protein, 710 aa, Artificial Sequence
  Heavy chain
QVQLQQSDAELVKPGASVKISCKVSGYTFTDHTIHWMKQRPEQGLEWIGYIYPRDAITKYNEKFKGKATLTADKSSSTAYMQLNSLTSEDSAVYFCARWGYYFGSTSYYFDFWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDVLMTQTPLSLPVSLGDQASISCRSSQNIVHSNGNTYLDWYLQKPGQSPKLLIYKVSNRFSGVPDRFSGSGSGTDFTLKISRVEAEDLGVYYCFQGSHVPPTFGAGTKLELKGGGGSGGGGSGGGGSGGGGSEVQLQQSGPELVKPGASVKISCKASGYTFTDYYYMNWVKQSHGKSLEWIGYIYPNNGGTRYNQKFKGKATLTVDKSSSTAYMELRSLTSEDSAVYYCARGGNWNWYFDVWGTGTTVTVSS

SEQ ID NO: 180 - protein, 704 aa, Artificial Sequence
  Heavy chain
QVQLQQSDAELVKPGASVKISCKVSGYTFTDHTIHWMKQRPEQGLEWIGYIYPRDAITKYNEKFKGKATLTADKSSSTAYMQLNSLTSEDSAVYFCARWGYYFGSTSYYFDFWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDIVMTQSHKFMSTSVGDRVSITCKASQDVSNAVAWYQQKPGQSPKLLIYWASTRHNGVPDRFTGSGSGTDYILTISSVQAEDLALYYCQQHYRTPYTFGGGTKLEIKGGGGSGGGGSGGGGSGGGGSKVQLQQSGAELVKPGASVKLSCKASGYTFTEYIIHWVKQKSGQGLEWIGWFYPGSGNIKYNEKFKDKATLTADKSSSTVYMELSRLTSEDSAVYFCTRHEGGSNFFPYWGQGTLVTVSA

SEQ ID NO: 181 - protein, 707 aa, Artificial Sequence
  Heavy chain
QVQLQQSDAELVKPGASVKISCKVSGYTFTDHTIHWMKQRPEQGLEWIGYIYPRDAITKYNEKFKGKATLTADKSSSTAYMQLNSLTSEDSAVYFCARWGYYFGSTSYYFDFWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDIELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGCGTKLTVLGGGGSGGGGSGGGGSGGGGSEVQLVQSGGGVERPGGSLRLSCAASGFTFDDYGMSWVRQAPGKCLEWVSGINWNGGSTGYADSVKGRVTISRDNAKNSLYLQMNSLRAEDTAVYYCAKILGAGRGWYFDLWGKGTTVTVSS

SEQ ID NO: 182 - protein, 707 aa, Artificial Sequence
  Heavy chain
QVQLQQSDAELVKPGASVKISCKVSGYTFTDHTIHWMKQRPEQGLEWIGYIYPRDAITKYNEKFKGKATLTADKSSSTAYMQLNSLTSEDSAVYFCARWGYYFGSTSYYFDFWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGGGGSGGGGSGGGGSGGGGSEVQLVQSGGGVERPGGSLRLSCAASGFTFDDYGMSWVRQAPGKGLEWVSGINWNGGSTGYADSVKGRVTISRDNAKNSLYLQMNSLRAEDTAVYYCAKILGAGRGWYFDLWGKGTTVTVSS

SEQ ID NO: 183 - protein, 707 aa, Artificial Sequence
  Heavy chain
QVQLQQSDAELVKPGASVKISCKVSGYTFTDHTIHWMKQRPEQGLEWIGYIYPRDAITKYNEKFKGKATLTADKSSSTAYMQLNSLTSEDSAVYFCARWGYYFGSTSYYFDFWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSSSELTQDPAVSVALGQTVRITCQGDSLRSYYASWYQQKPGQAPVLVIYGKTNRPSGIPDRFSGSSSGNTASLTITGAQAEDEADYYCNSRDSSGTHVVFGGGTKLTVLGGGGSGGGGSGGGGSGGGGSEVQLVQSGGGVERPGGSLRLSCAASGFTFDDYGMSWVRQAPGKGLEWVSGINWSGGSTGYADSVKGRVTISRDNAKNSLYLQMNSLRAEDTAVYYCAKILGAGRGWYFDLWGKGTTVTVSS

SEQ ID NO: 184 - protein, 707 aa, Artificial Sequence
  Heavy chain
QVQLQQSDAELVKPGASVKISCKVSGYTFTDHTIHWMKQRPEQGLEWIGYIYPRDAITKYNEKFKGKATLTADKSSSTAYMQLNSLTSEDSAVYFCARWGYYFGSTSYYFDFWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSSSELTQDPAVSVALGQTVRITCQGDSLRSYYASWYQQKPGQAPVLVIYGKANRPSGIPDRFSGSSSGNTASLTITGAQAEDEADYYCNSRDSSGAHVVFGGGTKLTVLGGGGSGGGGSGGGGSGGGGSEVQLVQSGGGVERPGGSLRLSCAASGFTFDDYGMSWVRQAPGKGLEWVSGINWSGGSTGYADSVKGRVTISRDNAKNSLYLQMNSLRAEDTAVYYCAKILGAGRGWYFDLWGKGTTVTVSS

SEQ ID NO: 185 - protein, 707 aa, Artificial Sequence
  Heavy chain
QVQLQQSDAELVKPGASVKISCKVSGYTFTDHTIHWMKQRPEQGLEWIGYIYPRDAITKYNEKFKGKATLTADKSSSTAYMQLNSLTSEDSAVYFCARWGYYFGSTSYYFDFWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGGGGSGGGGSGGGGSGGGGSEVQLVQSGGGVERPGGSLRLSCAASGFTFDDYGMSWVRQAPGKGLEWVSGINWSGGSTGYADSVKGRVTISRDNAKNSLYLQMNSLRAEDTAVYYCAKILGAGRGWYFDLWGKGTTVTVSS

SEQ ID NO: 186 - protein, 707 aa, Artificial Sequence
  Heavy chain
QVQLQQSDAELVKPGASVKISCKVSGYTFTDHTIHWMKQRPEQGLEWIGYIYPRDAITKYNEKFKGKATLTADKSSSTAYMQLNSLTSEDSAVYFCARWGYYFGSTSYYFDFWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSSSELTQDPAVSVALGQTVRITCQGDSLRSYYASWYQQKPGQAPVLVIYGKTNRPSGIPDRFSGSSSGNTASLTITGAQAEDEADYYCNSRDSSGDHVVFGGGTKLTVLGGGGSGGGGSGGGGSGGGGSEVQLVQSGGGVERPGGSLRLSCAASGFTFDDYGMSWVRQAPGKGLEWVSGINWAGGSTGYADSVKGRVTISRDNAKNSLYLQMNSLRAEDTAVYYCAKILGAGRGWYFDLWGKGTTVTVSS

SEQ ID NO: 187 - protein, 707 aa, Artificial Sequence
  Heavy chain
QVQLQQSDAELVKPGASVKISCKVSGYTFTDHTIHWMKQRPEQGLEWIGYIYPRDAITKYNEKFKGKATLTADKSSSTAYMQLNSLTSEDSAVYFCARWGYYFGSTSYYFDFWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSSSELTQDPAVSVALGQTVRITCQGDSLRSYYASWYQQKPGQAPVLVIYGKDNRPSGIPDRFSGSSSGNTASLTITGAQAEDEADYYCNSRDSSGDHVVFGGGTKLTVLGGGGSGGGGSGGGGSGGGGSEVQLVQSGGGVERPGGSLRLSCAASGFTFDDYGMSWVRQAPGKGLEWVSGINWTGGSTGYADSVKGRVTISRDNAKNSLYLQMNSLRAEDTAVYYCAKILGAGRGWYFDLWGKGTTVTVSS

SEQ ID NO: 188 - protein, 214 aa, Artificial Sequence
  Light chain
DIVMTQSQKFMSTTVGDRVSITCKASQNVGTGVVWYQQRPGQSPKLLIYSPSNRYTGVPDRFTGSGSGTDFTLTITNIQSEDLADYFCQQYSTYPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 189 - protein, 704 aa, Artificial Sequence
  Heavy chain
QVQLQQSDAELVKPGASVKISCKVSGYTFTDHTIHWMKQRPEQGLEWIGYIYPRDVITQYNEKFKGKATLTADKSSSTAYMQLNSLTSEDSAVYLCARWGYFYGSRSYYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDIVMTQSHKFMSTSVGDRVSITCKASQDVITAVAWYQQKPGQSPKLLIYWASTRHTGVPDRFTGTGSGTDYTLTISSVQAEDLALYYCQQHYSTPWTFGGGTKLEIKGGGGSGGGGSGGGGSGGGGSQVQLQQSGAELVKPGASVKLSCKAFDYTFTSYDINWVKQRPGQGLEWIGWIDPGSGNTKYNEKFKGKATLTADKSSSTAYMHLSSLTSEDSAVYFCARKNYGGSYAFTYWGQGTLVTVA

SEQ ID NO: 190 - protein, 706 aa, Artificial Sequence
  Heavy chain
QVQLQQSDAELVKPGASVKISCKVSGYTFTDHTIHWMKQRPEQGLEWIGYIYPRDVITQYNEKFKGKATLTADKSSSTAYMQLNSLTSEDSAVYLCARWGYFYGSRSYYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDIVMTQSHKFMSTSVGDRVSITCKASQDVSTAVAWYQQKPGQSPKVLIYWASTRHTGVPDRFTGSGSGTDYILTISSVQAEDLALYYCQQHYSTPYTFGGGTKLEIKGGGGSGGGGSGGGGSGGGGSKVQLQQSGAELVKTGTSVKLSCKASGYTFTEYIIHWVKQRSGQGLEWIGWFYPGSGSIKYNEKFKDKATLTADKSSSTVYMELSRLTSEDSAVYFCARHEEGGYSAWFPYWGQGTLVTVSA

SEQ ID NO: 191 - protein, 709 aa, Artificial Sequence
  Heavy chain
QVQLQQSDAELVKPGASVKISCKVSGYTFTDHTIHWMKQRPEQGLEWIGYIYPRDVITQYNEKFKGKATLTADKSSSTAYMQLNSLTSEDSAVYLCARWGYFYGSRSYYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDVLMTQTPLSLPVSLGDQASISCRSSQSIVHSNGDTYLDWYLQKPGQSPKLLIYKVSNRFSGVPDRFSGSGSGTDFTLKISRVVAEDLGVYYCFRGSHIPPTFGAGTKLEKGGGGSGGGGSGGGGSGGGGSEVQLQQSGPELVKPGASVKISCKASGYTFTDYYYLNWVKQSHGKSLEWIGYIYPNNGDTSYNQKFKGKTTLTVDKSSSTAYMEFRSLTSEDSAVYYCTRGSNWIWYFDVWGTGTTVTVSS

SEQ ID NO: 192 - protein, 699 aa, Artificial Sequence
  Heavy chain
QVQLQQSDAELVKPGASVKISCKVSGYTFTDHTIHWMKQRPEQGLEWIGYIYPRDVITQYNEKFKGKATLTADKSSSTAYMQLNSLTSEDSAVYLCARWGYFYGSRSYYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSSIVMTQTPKFLPVSAGDRVTMTCKASQNVGNNVAWYQQKPGQSPKLLISYASNRYTGVPDRFTGSGSGTDFFTISSVQVEDLAVYFCQQHYSSPLTFGAGTKLELKGGGGSGGGGSGGGGSGGGGSQVQLKQSGAELVKPGASVKISCKASGYSFTDYYINWVKQRPGQGLEWIGKIGPGSGNTYYNEKFEGKATLTADKSSSTAYMQLSSLTSEDSAVYFCASTGPFAYWGQGTLVTWSA

SEQ ID NO: 193 - protein, 703 aa, Artificial Sequence
  Heavy chain
QVQLQQSDAELVKPGASVKISCKVSGYTFTDHTIHWMKQRPEQGLEWIGYIYPRDVITQYNEKFKGKATLTADKSSSTAYMQLNSLTSEDSAVYLCARWGYFYGSRSYYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDIVMTQSHKFMSTSVGDRVSITCKASQDVGTAVAWYQQKPGQSPKLLIYWASTRHTGVPDRFTGSGSGTDFTLTISNVQSEDLADYFCQQYSSYPYTFGGGTKLEIKGGGGSGGGGSGGGGSGGGGSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRRLGPFAYWGQGTLVTVSA

SEQ ID NO: 194 - protein, 710 aa, Artificial Sequence
  Heavy chain
QVQLQQSDAELVKPGASVKISCKVSGYTFTDHTIHWMKQRPEQGLEWIGYIYPRDVITQYNEKFKGKATLTADKSSSTAYMQLNSLTSEDSAVYLCARWGYFYGSRSYYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDVLMTQTPLSLPVSLGDQASISCRSSQNIVHSNGNTYLDWYLQKPGQSPKLLIYKVSNRFSGVPDRFSGSGSGTDFTLKISRVEAEDLGVYYCFQGSHVPPTFGAGTKLELKGGGGSGGGGSGGGGSGGGGSEVQLQQSGPELVKPGASVKISCKASGYTFTDYYYMNWVKQSHGKSLEWIGYIYPNNGGTRYNQKFKGKATLTVDKSSSTAYMELRSLTSEDSAVYYCARGGNWNWYFDVWGTGTTVTVSS

SEQ ID NO: 195 - protein, 704 aa, Artificial Sequence
  Heavy chain
QVQLQQSDAELVKPGASVKISCKVSGYTFTDHTIHWMKQRPEQGLEWIGYIYPRDVITQYNEKFKGKATLTADKSSSTAYMQLNSLTSEDSAVYLCARWGYFYGSRSYYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDIVMTQSHKFMSTSVGDRVSITCKASQDVSNAVAWYQQKPGQSPKLLIYWASTRHNGVPDRFTGSGSGTDYILTISSVQAEDLALYYCQQHYRTPYTFGGGTKLEIKGGGGSGGGGSGGGGSGGGGSKVQLQQSGAELVKPGASVKLSCKASGYTFTEYIIHWVKQKSGQGLEWIGWFYPGSGNIKYNEKFKDKATLTADKSSSTVYMELSRLTSEDSAVYFCTRHEGGSNFFPYWGQGTLVTVSA

SEQ ID NO: 196 - protein, 707 aa, Artificial Sequence
  Heavy chain
QVQLQQSDAELVKPGASVKISCKVSGYTFTDHTIHWMKQRPEQGLEWIGYIYPRDVITQYNEKFKGKATLTADKSSSTAYMQLNSLTSEDSAVYLCARWGYFYGSRSYYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDIELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGCGTKLTVLGGGGSGGGGSGGGGSGGGGSEVQLVQSGGGVERPGGSLRLSCAASGFTFDDYGMSWVRQAPGKCLEWVSGINWNGGSTGYADSVKGRVTISRDNAKNSLYLQMNSLRAEDTAVYYCAKILGAGRGWYFDLWGKGTTVTVSS

SEQ ID NO: 197 - protein, 707 aa, Artificial Sequence
  Heavy chain
QVQLQQSDAELVKPGASVKISCKVSGYTFTDHTIHWMKQRPEQGLEWIGYIYPRDVITQYNEKFKGKATLTADKSSSTAYMQLNSLTSEDSAVYLCARWGYFYGSRSYYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGGGGSGGGGSGGGGSGGGGSEVQLVQSGGGVERPGGSLRLSCAASGFTFDDYGMSWVRQAPGKGLEWVSGINWNGGSTGYADSVKGRVTISRDNAKNSLYLQMNSLRAEDTAVYYCAKILGAGRGWYFDLWGKGTTVTVSS

SEQ ID NO: 198 - protein, 707 aa, Artificial Sequence
  Heavy chain
QVQLQQSDAELVKPGASVKISCKVSGYTFTDHTIHWMKQRPEQGLEWIGYIYPRDVITQYNEKFKGKATLTADKSSSTAYMQLNSLTSEDSAVYLCARWGYFYGSRSYYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSSSELTQDPAVSVALGQTVRITCQGDSLRSYYASWYQQKPGQAPVLVIYGKTNRPSGIPDRFSGSSSGNTASLTITGAQAEDEADYYCNSRDSSGTHVVFGGGTKLTVLGGGGSGGGGSGGGGSGGGGSEVQLVQSGGGVERPGGSLRLSCAASGFTFDDYGMSWVRQAPGKGLEWVSGINWSGGSTGYADSVKGRVTISRDNAKNSLYLQMNSLRAEDTAVYYCAKILGAGRGWYFDLWGKGTTVTVSS

SEQ ID NO: 199 - protein, 707 aa, Artificial Sequence
  Heavy chain
QVQLQQSDAELVKPGASVKISCKVSGYTFTDHTIHWMKQRPEQGLEWIGYIYPRDVITQYNEKFKGKATLTADKSSSTAYMQLNSLTSEDSAVYLCARWGYFYGSRSYYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSSSELTQDPAVSVALGQTVRITCQGDSLRSYYASWYQQKPGQAPVLVIYGKANRPSGIPDRFSGSSSGNTASLTITGAQAEDEADYYCNSRDSSGAHVVFGGGTKLTVLGGGGSGGGGSGGGGSGGGGSEVQLVQSGGGVERPGGSLRLSCAASGFTFDDYGMSWVRQAPGKGLEWVSGINWSGGSTGYADSVKGRVTISRDNAKNSLYLQMNSLRAEDTAVYYCAKILGAGRGWYFDLWGKGTTVTVSS

SEQ ID NO: 200 - protein, 707 aa, Artificial Sequence
  Heavy chain
QVQLQQSDAELVKPGASVKISCKVSGYTFTDHTIHWMKQRPEQGLEWIGYIYPRDVITQYNEKFKGKATLTADKSSSTAYMQLNSLTSEDSAVYLCARWGYFYGSRSYYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGGGGSGGGGSGGGGSGGGGSEVQLVQSGGGVERPGGSLRLSCAASGFTFDDYGMSWVRQAPGKGLEWVSGINWSGGSTGYADSVKGRVTISRDNAKNSLYLQMNSLRAEDTAVYYCAKILGAGRGWYFDLWGKGTTVTVSS

SEQ ID NO: 201 - protein, 707 aa, Artificial Sequence
  Heavy chain
QVQLQQSDAELVKPGASVKISCKVSGYTFTDHTIHWMKQRPEQGLEWIGYIYPRDVITQYNEKFKGKATLTADKSSSTAYMQLNSLTSEDSAVYLCARWGYFYGSRSYYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSSSELTQDPAVSVALGQTVRITCQGDSLRSYYASWYQQKPGQAPVLVIYGKTNRPSGIPDRFSGSSSGNTASLTITGAQAEDEADYYCNSRDSSGDHVVFGGGTKLTVLGGGGSGGGGSGGGGSGGGGSEVQLVQSGGGVERPGGSLRLSCAASGFTFDDYGMSWVRQAPGKGLEWVSGINWAGGSTGYADSVKGRVTISRDNAKNSLYLQMNSLRAEDTAVYYCAKILGAGRGWYFDLWGKGTTVTVSS

SEQ ID NO: 202 - protein, 707 aa, Artificial Sequence
  Heavy chain
QVQLQQSDAELVKPGASVKISCKVSGYTFTDHTIHWMKQRPEQGLEWIGYIYPRDVITQYNEKFKGKATLTADKSSSTAYMQLNSLTSEDSAVYLCARWGYFYGSRSYYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSSSELTQDPAVSVALGQTVRITCQGDSLRSYYASWYQQKPGQAPVLVIYGKDNRPSGIPDRFSGSSSGNTASLTITGAQAEDEADYYCNSRDSSGDHVVFGGGTKLTVLGGGGSGGGGSGGGGSGGGGSEVQLVQSGGGVERPGGSLRLSCAASGFTFDDYGMSWVRQAPGKGLEWVSGINWTGGSTGYADSVKGRVTISRDNAKNSLYLQMNSLRAEDTAVYYCAKILGAGRGWYFDLWGKGTTVTVSS

SEQ ID NO: 203 - protein, 214 aa, Artificial Sequence
  Light chain
DIVMTQSQKFMSTTVGDRVNITCKASQNVGTAVAWYQQKPGQSPKLLIYSASNRYTGVPDRFTGSGSGTDFTLTITNMQSKDLADYFCQQYSSYPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 204 - protein, 704 aa, Artificial Sequence
  Heavy chain
QVQLVQSGAEVKKPGSSVKVSCKVSGYTFTDHTIHWMKQRPGQGLEWIGYIYPRDVITQYNEKFKGKVTLTADKSTSTAYMELSSLRSEDTAVYLCARWGYFYGSRSYYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDIVMTQSHKFMSTSVGDRVSITCKASQDVITAVAWYQQKPGQSPKLLIYWASTRHTGVPDRFTGTGSGTDYTLTISSVQAEDLALYYCQQHYSTPWTFGGGTKLEIKGGGGSGGGGSGGGGSGGGGSQVQLQQSGAELVKPGASVKLSCKAFDYTFTSYDINWVKQRPGQGLEWIGWIDPGSGNTKYNEKFKGKATLTADKSSSTAYMHLSSLTSEDSAVYFCARKNYGGSYAFTYWGQGTLVTVA

SEQ ID NO: 205 - protein, 706 aa, Artificial Sequence
  Heavy chain
QVQLVQSGAEVKKPGSSVKVSCKVSGYTFTDHTIHWMKQRPGQGLEWIGYIYPRDVITQYNEKFKGKVTLTADKSTSTAYMELSSLRSEDTAVYLCARWGYFYGSRSYYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDIVMTQSHKFMSTSVGDRVSITCKASQDVSTAVAWYQQKPGQSPKVLIYWASTRHTGVPDRFTGSGSGTDYILTISSVQAEDLALYYCQQHYSTPYTFGGGTKLEIKGGGGSGGGGSGGGGSGGGGSKVQLQQSGAELVKTGTSVKLSCKASGYTFTEYIIHWVKQRSGQGLEWIGWFYPGSGSIKYNEKFKDKATLTADKSSSTVYMELSRLTSEDSAVYFCARHEEGGYSAWFPYWGQGTLVTVSA

SEQ ID NO: 206 - protein, 709 aa, Artificial Sequence
  Heavy chain
QVQLVQSGAEVKKPGSSVKVSCKVSGYTFTDHTIHWMKQRPGQGLEWIGYIYPRDVITQYNEKFKGKVTLTADKSTSTAYMELSSLRSEDTAVYLCARWGYFYGSRSYYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDVLMTQTPLSLPVSLGDQASISCRSSQSIVHSNGDTYLDWYLQKPGQSPKLLIYKVSNRFSGVPDRFSGSGSGTDFTLKISRVVAEDLGVYYCFRGSHIPPTFGAGTKLEKGGGGSGGGGSGGGGSGGGGSEVQLQQSGPELVKPGASVKISCKASGYTFTDYYYLNWVKQSHGKSLEWIGYIYPNNGDTSYNQKFKGKTTLTVDKSSSTAYMEFRSLTSEDSAVYYCTRGSNWIWYFDVWGTGTTVTVSS

SEQ ID NO: 207 - protein, 699 aa, Artificial Sequence
  Heavy chain
QVQLVQSGAEVKKPGSSVKVSCKVSGYTFTDHTIHWMKQRPGQGLEWIGYIYPRDVITQYNEKFKGKVTLTADKSTSTAYMELSSLRSEDTAVYLCARWGYFYGSRSYYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSSIVMTQTPKFLPVSAGDRVTMTCKASQNVGNNVAWYQQKPGQSPKLLISYASNRYTGVPDRFTGSGSGTDFFTISSVQVEDLAVYFCQQHYSSPLTFGAGTKLELKGGGGSGGGGSGGGGSGGGGSQVQLKQSGAELVKPGASVKISCKASGYSFTDYYINWVKQRPGQGLEWIGKIGPGSGNTYYNEKFEGKATLTADKSSSTAYMQLSSLTSEDSAVYFCASTGPFAYWGQGTLVTWSA

SEQ ID NO: 208 - protein, 703 aa, Artificial Sequence
  Heavy chain
QVQLVQSGAEVKKPGSSVKVSCKVSGYTFTDHTIHWMKQRPGQGLEWIGYIYPRDVITQYNEKFKGKVTLTADKSTSTAYMELSSLRSEDTAVYLCARWGYFYGSRSYYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDIVMTQSHKFMSTSVGDRVSITCKASQDVGTAVAWYQQKPGQSPKLLIYWASTRHTGVPDRFTGSGSGTDFTLTISNVQSEDLADYFCQQYSSYPYTFGGGTKLEIKGGGGSGGGGSGGGGSGGGGSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRRLGPFAYWGQGTLVTVSA

SEQ ID NO: 209 - protein, 710 aa, Artificial Sequence
  Heavy chain
QVQLVQSGAEVKKPGSSVKVSCKVSGYTFTDHTIHWMKQRPGQGLEWIGYIYPRDVITQYNEKFKGKVTLTADKSTSTAYMELSSLRSEDTAVYLCARWGYFYGSRSYYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDVLMTQTPLSLPVSLGDQASISCRSSQNIVHSNGNTYLDWYLQKPGQSPKLLIYKVSNRFSGVPDRFSGSGSGTDFTLKISRVEAEDLGVYYCFQGSHVPPTFGAGTKLELKGGGGSGGGGSGGGGSGGGGSEVQLQQSGPELVKPGASVKISCKASGYTFTDYYYMNWVKQSHGKSLEWIGYIYPNNGGTRYNQKFKGKATLTVDKSSSTAYMELRSLTSEDSAVYYCARGGNWNWYFDVWGTGTTVTVSS

SEQ ID NO: 210 - protein, 704 aa, Artificial Sequence
  Heavy chain
QVQLVQSGAEVKKPGSSVKVSCKVSGYTFTDHTIHWMKQRPGQGLEWIGYIYPRDVITQYNEKFKGKVTLTADKSTSTAYMELSSLRSEDTAVYLCARWGYFYGSRSYYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDIVMTQSHKFMSTSVGDRVSITCKASQDVSNAVAWYQQKPGQSPKLLIYWASTRHNGVPDRFTGSGSGTDYILTISSVQAEDLALYYCQQHYRTPYTFGGGTKLEIKGGGGSGGGGSGGGGSGGGGSKVQLQQSGAELVKPGASVKLSCKASGYTFTEYIIHWVKQKSGQGLEWIGWFYPGSGNIKYNEKFKDKATLTADKSSSTVYMELSRLTSEDSAVYFCTRHEGGSNFFPYWGQGTLVTVSA

SEQ ID NO: 211 - protein, 707 aa, Artificial Sequence
  Heavy chain
QVQLVQSGAEVKKPGSSVKVSCKVSGYTFTDHTIHWMKQRPGQGLEWIGYIYPRDVITQYNEKFKGKVTLTADKSTSTAYMELSSLRSEDTAVYLCARWGYFYGSRSYYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDIELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGCGTKLTVLGGGGSGGGGSGGGGSGGGGSEVQLVQSGGGVERPGGSLRLSCAASGFTFDDYGMSWVRQAPGKCLEWVSGINWNGGSTGYADSVKGRVTISRDNAKNSLYLQMNSLRAEDTAVYYCAKILGAGRGWYFDLWGKGTTVTVSS

SEQ ID NO: 212 - protein, 707 aa, Artificial Sequence
  Heavy chain
QVQLVQSGAEVKKPGSSVKVSCKVSGYTFTDHTIHWMKQRPGQGLEWIGYIYPRDVITQYNEKFKGKVTLTADKSTSTAYMELSSLRSEDTAVYLCARWGYFYGSRSYYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGGGGSGGGGSGGGGSGGGGSEVQLVQSGGGVERPGGSLRLSCAASGFTFDDYGMSWVRQAPGKGLEWVSGINWNGGSTGYADSVKGRVTISRDNAKNSLYLQMNSLRAEDTAVYYCAKILGAGRGWYFDLWGKGTTVTVSS

SEQ ID NO: 213 - protein, 707 aa, Artificial Sequence
  Heavy chain
QVQLVQSGAEVKKPGSSVKVSCKVSGYTFTDHTIHWMKQRPGQGLEWIGYIYPRDVITQYNEKFKGKVTLTADKSTSTAYMELSSLRSEDTAVYLCARWGYFYGSRSYYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSSSELTQDPAVSVALGQTVRITCQGDSLRSYYASWYQQKPGQAPVLVIYGKTNRPSGIPDRFSGSSSGNTASLTITGAQAEDEADYYCNSRDSSGTHVVFGGGTKLTVLGGGGSGGGGSGGGGSGGGGSEVQLVQSGGGVERPGGSLRLSCAASGFTFDDYGMSWVRQAPGKGLEWVSGINWSGGSTGYADSVKGRVTISRDNAKNSLYLQMNSLRAEDTAVYYCAKILGAGRGWYFDLWGKGTTVTVSS

SEQ ID NO: 214 - protein, 707 aa, Artificial Sequence
  Heavy chain
QVQLVQSGAEVKKPGSSVKVSCKVSGYTFTDHTIHWMKQRPGQGLEWIGYIYPRDVITQYNEKFKGKVTLTADKSTSTAYMELSSLRSEDTAVYLCARWGYFYGSRSYYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSSSELTQDPAVSVALGQTVRITCQGDSLRSYYASWYQQKPGQAPVLVIYGKANRPSGIPDRFSGSSSGNTASLTITGAQAEDEADYYCNSRDSSGAHVVFGGGTKLTVLGGGGSGGGGSGGGGSGGGGSEVQLVQSGGGVERPGGSLRLSCAASGFTFDDYGMSWVRQAPGKGLEWVSGINWSGGSTGYADSVKGRVTISRDNAKNSLYLQMNSLRAEDTAVYYCAKILGAGRGWYFDLWGKGTTVTVSS

SEQ ID NO: 215 - protein, 707 aa, Artificial Sequence
  Heavy chain
QVQLVQSGAEVKKPGSSVKVSCKVSGYTFTDHTIHWMKQRPGQGLEWIGYIYPRDVITQYNEKFKGKVTLTADKSTSTAYMELSSLRSEDTAVYLCARWGYFYGSRSYYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGGGGSGGGGSGGGGSGGGGSEVQLVQSGGGVERPGGSLRLSCAASGFTFDDYGMSWVRQAPGKGLEWVSGINWSGGSTGYADSVKGRVTISRDNAKNSLYLQMNSLRAEDTAVYYCAKILGAGRGWYFDLWGKGTTVTVSS

SEQ ID NO: 216 - protein, 707 aa, Artificial Sequence
  Heavy chain
QVQLVQSGAEVKKPGSSVKVSCKVSGYTFTDHTIHWMKQRPGQGLEWIGYIYPRDVITQYNEKFKGKVTLTADKSTSTAYMELSSLRSEDTAVYLCARWGYFYGSRSYYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSSSELTQDPAVSVALGQTVRITCQGDSLRSYYASWYQQKPGQAPVLVIYGKTNRPSGIPDRFSGSSSGNTASLTITGAQAEDEADYYCNSRDSSGDHVVFGGGTKLTVLGGGGSGGGGSGGGGSGGGGSEVQLVQSGGGVERPGGSLRLSCAASGFTFDDYGMSWVRQAPGKGLEWVSGINWAGGSTGYADSVKGRVTISRDNAKNSLYLQMNSLRAEDTAVYYCAKILGAGRGWYFDLWGKGTTVTVSS

SEQ ID NO: 217 - protein, 707 aa, Artificial Sequence
  Heavy chain
QVQLVQSGAEVKKPGSSVKVSCKVSGYTFTDHTIHWMKQRPGQGLEWIGYIYPRDVITQYNEKFKGKVTLTADKSTSTAYMELSSLRSEDTAVYLCARWGYFYGSRSYYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSSSELTQDPAVSVALGQTVRITCQGDSLRSYYASWYQQKPGQAPVLVIYGKDNRPSGIPDRFSGSSSGNTASLTITGAQAEDEADYYCNSRDSSGDHVVFGGGTKLTVLGGGGSGGGGSGGGGSGGGGSEVQLVQSGGGVERPGGSLRLSCAASGFTFDDYGMSWVRQAPGKGLEWVSGINWTGGSTGYADSVKGRVTISRDNAKNSLYLQMNSLRAEDTAVYYCAKILGAGRGWYFDLWGKGTTVTVSS

SEQ ID NO: 218 - protein, 214 aa, Artificial Sequence
  Light chain
DIQMTQSQSSLSASVGDRVGITCKASQNVGTAVAWYQQKPGKAPKLLIYSASNRYTGVPSRFSGSGSGTDFTLTISSLQPKDFATYFCQQYSSYPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 219 - protein, 704 aa, Artificial Sequence
  Heavy chain
EVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDIVMTQSHKFMSTSVGDRVSITCKASQDVITAVAWYQQKPGQSPKLLIYWASTRHTGVPDRFTGTGSGTDYTLTISSVQAEDLALYYCQQHYSTPWTFGGGTKLEIKGGGGSGGGGSGGGGSGGGGSQVQLQQSGAELVKPGASVKLSCKAFDYTFTSYDINWVKQRPGQGLEWIGWIDPGSGNTKYNEKFKGKATLTADKSSSTAYMHLSSLTSEDSAVYFCARKNYGGSYAFTYWGQGTLVTVA

SEQ ID NO: 220 - protein, 706 aa, Artificial Sequence
  Heavy chain
EVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDIVMTQSHKFMSTSVGDRVSITCKASQDVSTAVAWYQQKPGQSPKVLIYWASTRHTGVPDRFTGSGSGTDYILTISSVQAEDLALYYCQQHYSTPYTFGGGTKLEIKGGGGSGGGGSGGGGSGGGGSKVQLQQSGAELVKTGTSVKLSCKASGYTFTEYIIHWVKQRSGQGLEWIGWFYPGSGSIKYNEKFKDKATLTADKSSSTVYMELSRLTSEDSAVYFCARHEEGGYSAWFPYWGQGTLVTVSA

SEQ ID NO: 221 - protein, 709 aa, Artificial Sequence
  Heavy chain
EVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDVLMTQTPLSLPVSLGDQASISCRSSQSIVHSNGDTYLDWYLQKPGQSPKLLIYKVSNRFSGVPDRFSGSGSGTDFTLKISRVVAEDLGVYYCFRGSHIPPTFGAGTKLEKGGGGSGGGGSGGGGSGGGGSEVQLQQSGPELVKPGASVKISCKASGYTFTDYYYLNWVKQSHGKSLEWIGYIYPNNGDTSYNQKFKGKTTLTVDKSSSTAYMEFRSLTSEDSAVYYCTRGSNWIWYFDVWGTGTTVTVSS

SEQ ID NO: 222 - protein, 699 aa, Artificial Sequence
  Heavy chain
EVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSSIVMTQTPKFLPVSAGDRVTMTCKASQNVGNNVAWYQQKPGQSPKLLISYASNRYTGVPDRFTGSGSGTDFFTISSVQVEDLAVYFCQQHYSSPLTFGAGTKLELKGGGGSGGGGSGGGGSGGGGSQVQLKQSGAELVKPGASVKISCKASGYSFTDYYINWVKQRPGQGLEWIGKIGPGSGNTYYNEKFEGKATLTADKSSSTAYMQLSSLTSEDSAVYFCASTGPFAYWGQGTLVTWSA

SEQ ID NO: 223 - protein, 703 aa, Artificial Sequence
  Heavy chain
EVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDIVMTQSHKFMSTSVGDRVSITCKASQDVGTAVAWYQQKPGQSPKLLIYWASTRHTGVPDRFTGSGSGTDFTLTISNVQSEDLADYFCQQYSSYPYTFGGGTKLEIKGGGGSGGGGSGGGGSGGGGSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRRLGPFAYWGQGTLVTVSA

SEQ ID NO: 224 - protein, 710 aa, Artificial Sequence
  Heavy chain
EVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDVLMTQTPLSLPVSLGDQASISCRSSQNIVHSNGNTYLDWYLQKPGQSPKLLIYKVSNRFSGVPDRFSGSGSGTDFTLKISRVEAEDLGVYYCFQGSHVPPTFGAGTKLELKGGGGSGGGGSGGGGSGGGGSEVQLQQSGPELVKPGASVKISCKASGYTFTDYYYMNWVKQSHGKSLEWIGYIYPNNGGTRYNQKFKGKATLTVDKSSSTAYMELRSLTSEDSAVYYCARGGNWNWYFDVWGTGTTVTVSS

SEQ ID NO: 225 - protein, 704 aa, Artificial Sequence
  Heavy chain
EVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDIVMTQSHKFMSTSVGDRVSITCKASQDVSNAVAWYQQKPGQSPKLLIYWASTRHNGVPDRFTGSGSGTDYILTISSVQAEDLALYYCQQHYRTPYTFGGGTKLEIKGGGGSGGGGSGGGGSGGGGSKVQLQQSGAELVKPGASVKLSCKASGYTFTEYIIHWVKQKSGQGLEWIGWFYPGSGNIKYNEKFKDKATLTADKSSSTVYMELSRLTSEDSAVYFCTRHEGGSNFFPYWGQGTLVTVSA

SEQ ID NO: 226 - protein, 707 aa, Artificial Sequence
  Heavy chain
EVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDIELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGCGTKLTVLGGGGSGGGGSGGGGSGGGGSEVQLVQSGGGVERPGGSLRLSCAASGFTFDDYGMSWVRQAPGKCLEWVSGINWNGGSTGYADSVKGRVTISRDNAKNSLYLQMNSLRAEDTAVYYCAKILGAGRGWYFDLWGKGTTVTVSS

SEQ ID NO: 227 - protein, 707 aa, Artificial Sequence; identical to SEQ ID NO: 149
  Heavy chain

SEQ ID NO: 228 - protein, 707 aa, Artificial Sequence
  Heavy chain
EVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSSSELTQDPAVSVALGQTVRITCQGDSLRSYYASWYQQKPGQAPVLVIYGKTNRPSGIPDRFSGSSSGNTASLTITGAQAEDEADYYCNSRDSSGTHVVFGGGTKLTVLGGGGSGGGGSGGGGSGGGGSEVQLVQSGGGVERPGGSLRLSCAASGFTFDDYGMSWVRQAPGKGLEWVSGINWSGGSTGYADSVKGRVTISRDNAKNSLYLQMNSLRAEDTAVYYCAKILGAGRGWYFDLWGKGTTVTVSS

SEQ ID NO: 229 - protein, 707 aa, Artificial Sequence
  Heavy chain
EVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSSSELTQDPAVSVALGQTVRITCQGDSLRSYYASWYQQKPGQAPVLVIYGKANRPSGIPDRFSGSSSGNTASLTITGAQAEDEADYYCNSRDSSGAHVVFGGGTKLTVLGGGGSGGGGSGGGGSGGGGSEVQLVQSGGGVERPGGSLRLSCAASGFTFDDYGMSWVRQAPGKGLEWVSGINWSGGSTGYADSVKGRVTISRDNAKNSLYLQMNSLRAEDTAVYYCAKILGAGRGWYFDLWGKGTTVTVSS

SEQ ID NO: 230 - protein, 707 aa, Artificial Sequence
  Heavy chain
EVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGGGGSGGGGSGGGGSGGGGSEVQLVQSGGGVERPGGSLRLSCAASGFTFDDYGMSWVRQAPGKGLEWVSGINWSGGSTGYADSVKGRVTISRDNAKNSLYLQMNSLRAEDTAVYYCAKILGAGRGWYFDLWGKGTTVTVSS

SEQ ID NO: 231 - protein, 707 aa, Artificial Sequence
  Heavy chain
EVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSSSELTQDPAVSVALGQTVRITCQGDSLRSYYASWYQQKPGQAPVLVIYGKTNRPSGIPDRFSGSSSGNTASLTITGAQAEDEADYYCNSRDSSGDHVVFGGGTKLTVLGGGGSGGGGSGGGGSGGGGSEVQLVQSGGGVERPGGSLRLSCAASGFTFDDYGMSWVRQAPGKGLEWVSGINWAGGSTGYADSVKGRVTISRDNAKNSLYLQMNSLRAEDTAVYYCAKILGAGRGWYFDLWGKGTTVTVSS

SEQ ID NO: 232 - protein, 707 aa, Artificial Sequence
  Heavy chain
EVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSSSELTQDPAVSVALGQTVRITCQGDSLRSYYASWYQQKPGQAPVLVIYGKDNRPSGIPDRFSGSSSGNTASLTITGAQAEDEADYYCNSRDSSGDHVVFGGGTKLTVLGGGGSGGGGSGGGGSGGGGSEVQLVQSGGGVERPGGSLRLSCAASGFTFDDYGMSWVRQAPGKGLEWVSGINWTGGSTGYADSVKGRVTISRDNAKNSLYLQMNSLRAEDTAVYYCAKILGAGRGWYFDLWGKGTTVTVSS

SEQ ID NO: 233 - protein, 220 aa, Artificial Sequence; identical to SEQ ID NO: 146
  Light chain

SEQ ID NO: 234 - DNA, 45 bp, Artificial Sequence
  Primer
ctaatacgactcactatagggcaagcagtggtatcaacgcagagt

SEQ ID NO: 235 - DNA, 22 bp, Artificial Sequence
  Primer
ctaatacgactcactatagggc

SEQ ID NO: 236 - DNA, 26 bp, Artificial Sequence
  Primer
ctgctcactggatggtgggaagatgg

SEQ ID NO: 237 - DNA, 26 bp, Artificial Sequence
  Primer
ggggccagtggatagacagatggggg

SEQ ID NO: 238 - DNA, 57 bp, Artificial Sequence
  Primer
cgtatcgcctccctcgcgccatcagacgagtgcgtctaatacgactcactatagggc

SEQ ID NO: 239 - DNA, 57 bp, Artificial Sequence
  Primer
cgtatcgcctccctcgcgccatcagacgctcgacactaatacgactcactatagggc

SEQ ID NO: 240 - DNA, 57 bp, Artificial Sequence
  Primer
cgtatcgcctccctcgcgccatcagagacgcactcctaatacgactcactatagggc

SEQ ID NO: 241 - DNA, 57 bp, Artificial Sequence
  Primer
cgtatcgcctccctcgcgccatcagagcactgtagctaatacgactcactatagggc

SEQ ID NO: 242 - DNA, 57 bp, Artificial Sequence
  Primer
cgtatcgcctccctcgcgccatcagatcagacacgctaatacgactcactatagggc

SEQ ID NO: 243 - DNA, 57 bp, Artificial Sequence
  Primer
cgtatcgcctccctcgcgccatcagatatcgcgagctaatacgactcactatagggc

SEQ ID NO: 244 - DNA, 57 bp, Artificial Sequence
  Primer
cgtatcgcctccctcgcgccatcagcgtgtctctactaatacgactcactatagggc

SEQ ID NO: 245 - DNA, 57 bp, Artificial Sequence
  Primer
cgtatcgcctccctcgcgccatcagctcgcgtgtcctaatacgactcactatagggc

SEQ ID NO: 246 - DNA, 61 bp, Artificial Sequence
  Primer
ctatgcgccttgccagcccgctcagacgagtgcgtctgctcactggatggtgggaagatgg

SEQ ID NO: 247 - DNA, 61 bp, Artificial Sequence
  Primer
ctatgcgccttgccagcccgctcagacgctcgacactgctcactggatggtgggaagatgg

SEQ ID NO: 248 - DNA, 61 bp, Artificial Sequence
  Primer
ctatgcgccttgccagcccgctcagagacgcactcctgctcactggatggtgggaagatgg

SEQ ID NO: 249 - DNA, 61 bp, Artificial Sequence
  Primer
ctatgcgccttgccagcccgctcagagcactgtagctgctcactggatggtgggaagatgg

SEQ ID NO: 250 - DNA, 61 bp, Artificial Sequence
  Primer
ctatgcgccttgccagcccgctcagatcagacacgctgctcactggatggtgggaagatgg

SEQ ID NO: 251 - DNA, 61 bp, Artificial Sequence
  Primer
ctatgcgccttgccagcccgctcagatatcgcgagctgctcactggatggtgggaagatgg

SEQ ID NO: 252 - DNA, 61 bp, Artificial Sequence
  Primer
ctatgcgccttgccagcccgctcagcgtgtctctactgctcactggatggtgggaagatgg

SEQ ID NO: 253 - DNA, 61 bp, Artificial Sequence
  Primer
ctatgcgccttgccagcccgctcagctcgcgtgtcctgctcactggatggtgggaagatgg

SEQ ID NO: 254 - DNA, 57 bp, Artificial Sequence; identical to SEQ ID NO: 238
  Primer

SEQ ID NO: 255 - DNA, 57 bp, Artificial Sequence; identical to SEQ ID NO: 239
  Primer

SEQ ID NO: 256 - DNA, 57 bp, Artificial Sequence; identical to SEQ ID NO: 240
  Primer

SEQ ID NO: 257 - DNA, 57 bp, Artificial Sequence; identical to SEQ ID NO: 241
  Primer

SEQ ID NO: 258 - DNA, 57 bp, Artificial Sequence; identical to SEQ ID NO: 242
  Primer

SEQ ID NO: 259 - DNA, 57 bp, Artificial Sequence; identical to SEQ ID NO: 243
  Primer

SEQ ID NO: 260 - DNA, 57 bp, Artificial Sequence; identical to SEQ ID NO: 244
  Primer

SEQ ID NO: 261 - DNA, 57 bp, Artificial Sequence; identical to SEQ ID NO: 245
  Primer

SEQ ID NO: 262 - DNA, 61 bp, Artificial Sequence
  Primer
ctatgcgccttgccagcccgctcagacgagtgcgtggggccagtggatagacagatggggg

SEQ ID NO: 263 - DNA, 61 bp, Artificial Sequence
  Primer
ctatgcgccttgccagcccgctcagacgctcgacaggggccagtggatagacagatggggg

SEQ ID NO: 264 - DNA, 61 bp, Artificial Sequence
  Primer
ctatgcgccttgccagcccgctcagagacgcactcggggccagtggatagacagatggggg

SEQ ID NO: 265 - DNA, 61 bp, Artificial Sequence
  Primer
ctatgcgccttgccagcccgctcagagcactgtagggggccagtggatagacagatggggg

SEQ ID NO: 266 - DNA, 61 bp, Artificial Sequence
  Primer
ctatgcgccttgccagcccgctcagatcagacacgggggccagtggatagacagatggggg

SEQ ID NO: 267 - DNA, 61 bp, Artificial Sequence
  Primer
ctatgcgccttgccagcccgctcagatatcgcgagggggccagtggatagacagatggggg

SEQ ID NO: 268 - DNA, 61 bp, Artificial Sequence
  Primer
ctatgcgccttgccagcccgctcagcgtgtctctaggggccagtggatagacagatggggg

SEQ ID NO: 269 - DNA, 61 bp, Artificial Sequence
  Primer
ctatgcgccttgccagcccgctcagctcgcgtgtcggggccagtggatagacagatggggg

SEQ ID NO: 270 - protein, 329 aa, Artificial Sequence
  Primer
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLAQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 271 - protein, 707 aa, Artificial Sequence
  Primer
QVQLVQSGAEVKKPGSSVKVSCKVSGYTFTDHTIHWMKQRPGQGLEWIGYIYPRDVITQYNEKFKGKVTLTADKSTSTAYMELSSLRSEDTAVYLCARWGYFYGSRSYYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLAQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGGGGSGGGGSGGGGSGGGGSEVQLVQSGGGVERPGGSLRLSCAASGFTFDDYGMSWVRQAPGKGLEWVSGINWNGGSTGYADSVKGRVTISRDNAKNSLYLQMNSLRAEDTAVYYCAKILGAGRGWYFDLWGKGTTVTVSS

SEQ ID NO: 272 - protein, 13 aa, Artificial Sequence
  CDR
GYSYRNYAYYYDY

The invention claimed is:

1. A binding molecule comprising at least one antigen binding site that binds specifically to TNF-related apoptosis-inducing ligand receptor 2 (TRAILR2) and at least one antigen binding site that binds specifically to cadherin-17 (CDH17),
wherein the antigen binding site that binds specifically to TRAILR2 comprises heavy chain CDRs comprising of SEQ ID NO.:43 (CDR1), SEQ ID NO.:44 (CDR2) and SEQ ID NO.:48 (CDR3) and light chain CDRs comprising the amino acid sequences of SEQ ID NO.:49 (CDR1), SEQ ID NO.50 (CDR2) and SEQ ID NO.:54 (CDR3), and
wherein the antigen binding site that binds specifically to CDH17 comprises heavy chain CDRs comprising the amino acid sequences of SEQ ID NO.:70 (CDR1), SEQ ID NO.:71 (CDR2) and SEQ ID NO.:72 (CDR3) and light chain CDRs comprising the amino acid sequences of SEQ ID NO.:73 (CDR1), SEQ ID NO.74 (CDR2) and SEQ ID NO.:75 (CDR3).

2. The binding molecule of claim 1, wherein the molecule is bispecific and tetravalent.

3. The binding molecule of claim 1, wherein the at least one antigen binding site that binds specifically to cadherin-17 (CDH17) is an immunoglobulin (Ig) molecule and the at least one antigen binding site that binds specifically to TNF-related apoptosis-inducing ligand receptor 2 (TRAILR2) comprises one or more scFv(s).

4. The binding molecule of claim 3, wherein the one or more scFv(s) have a VL-VH orientation from N- to C-terminus.

5. The binding molecule of claim 3, wherein the one or more scFv(s) is fused to the C-terminus of the heavy chain of the Ig molecule.

6. The binding molecule of claim 3, wherein the Ig molecule is IgG.

7. The binding molecule of claim 3, wherein the one or more scFv(s) is fused to the Ig molecule by a peptide linker.

8. The binding molecule of claim 7, wherein the peptide linker has a length of about 4 to 20 amino acids.

9. The binding molecule of claim 1, wherein the antigen binding site that binds specifically to TRAILR2
comprises a heavy chain variable domain comprising the amino acid sequence of SEQ ID NO.:96 and a light chain variable domain comprising the amino acid sequence of SEQ ID NO.:97; or
comprises a heavy chain variable domain comprising the amino acid sequence of SEQ ID NO.:98 and a light chain variable domain comprising the amino acid sequence of SEQ ID NO.:99.

10. The binding molecule of claim 1, wherein the antigen binding site that binds specifically to CDH17
comprises a heavy chain variable domain comprising the amino acid sequence of SEQ ID NO.:114 and a light chain variable domain comprising the amino acid sequence of SEQ ID NO.:115; or
comprises a heavy chain variable domain comprising the amino acid sequence of SEQ ID NO.:116 and a light chain variable domain comprising the amino acid sequence of SEQ ID NO.:117.

11. A pharmaceutical composition comprising a binding molecule of claim 1 and a pharmaceutically acceptable carrier.

12. A pharmaceutical composition comprising a binding molecule of claim 9 and a pharmaceutically acceptable carrier.

13. A pharmaceutical composition comprising a binding molecule of claim 10 and a pharmaceutically acceptable carrier.

14. A binding molecule comprising at least one antigen binding site that binds specifically to TRAILR2 and at least one antigen binding site that binds specifically to CDH17, wherein said binding molecule comprises (i) a heavy chain comprising the amino acid sequence of SEQ ID NO. 196, or a heavy chain comprising the amino acid sequence of SEQ ID NO. 197, and (ii) a light chain comprising the amino acid sequence of SEQ ID NO. 203.

15. A binding molecule comprising at least one antigen binding site that binds specifically to TRAILR2 and at least one antigen binding site that binds specifically to CDH17, wherein said binding molecule comprises (i) a heavy chain comprising the amino acid sequence of SEQ ID NO. 211, or a heavy chain comprising the amino acid sequence of SEQ ID NO. 212; and (ii) a light chain comprising the amino acid sequence of SEQ ID NO. 218.

16. An isolated nucleic acid molecule encoding the heavy chain and/or the light chain of a binding molecule of claim 14.

17. An isolated nucleic acid molecule encoding the heavy chain and/or the light chain of a binding molecule of claim 15.

18. An expression vector comprising a nucleic acid molecule of claim 16.

19. An expression vector comprising a nucleic acid molecule of claim 17.

20. A host cell transfected with an expression vector of claim 18.

21. A host cell transfected with an expression vector of claim 19.

22. A method of manufacturing a binding molecule comprising:
(a) cultivating a host cell comprising an isolated nucleic acid molecule encoding the heavy chain of a binding molecule of claim 14 and an isolated nucleic acid molecule encoding the light chain of a binding molecule of claim 14 under conditions allowing expression of the binding molecule; and (b) recovering the binding molecule; and optionally (c) further purifying and/or modifying and/or formulating the binding molecule.

23. A method of manufacturing a binding molecule comprising:

(a) cultivating a host cell comprising an isolated nucleic acid molecule encoding the heavy chain of a binding molecule of claim 15 and an isolated nucleic acid molecule encoding the light chain of a binding molecule of claim 15 under conditions allowing expression of the binding molecule; and (b) recovering the binding molecule; and optionally (c) further purifying and/or modifying and/or formulating the binding molecule.

24. A pharmaceutical composition comprising a binding molecule of claim 14 and a pharmaceutically acceptable carrier.

25. A pharmaceutical composition comprising a binding molecule of claim 15 and a pharmaceutically acceptable carrier.

26. A binding molecule comprising at least one antigen binding site that binds specifically to TRAILR2 and at least one antigen binding site that binds specifically to CDH17, wherein the antigen binding site that binds specifically to TRAILR2 and the antigen binding site that binds specifically to CDH17 comprise:

a heavy chain variable domain comprising the amino acid sequence of SEQ ID NO.:96 and a light chain variable domain comprising the amino acid sequence of SEQ ID NO.:97, and a heavy chain variable domain comprising the amino acid sequence of SEQ ID NO.:114 and a light chain variable domain comprising the amino acid sequence of SEQ ID NO.:115, respectively; or a heavy chain variable domain comprising the amino acid sequence of SEQ ID NO.:96 and a light chain variable domain comprising the amino acid sequence of SEQ ID NO.:97, and a heavy chain variable domain comprising the amino acid sequence of SEQ ID NO.:116 and a light chain variable domain comprising the amino acid sequence of SEQ ID NO.:117, respectively;

or a heavy chain variable domain comprising the amino acid sequence of SEQ ID NO.:98 and a light chain variable domain comprising the amino acid sequence of SEQ ID NO.:99, and a heavy chain variable domain comprising the amino acid sequence of SEQ ID NO.:114 and a light chain variable domain comprising the amino acid sequence of SEQ ID NO.:115, respectively;

or a heavy chain variable domain comprising the amino acid sequence of SEQ ID NO.:98 and a light chain variable domain comprising the amino acid sequence of SEQ ID NO.:99, and a heavy chain variable domain comprising the amino acid sequence of SEQ ID NO.:116 and a light chain variable domain comprising the amino acid sequence of SEQ ID NO.:117, respectively.

27. The binding molecule of claim 26, wherein the molecule is bispecific and tetravalent.

28. The binding molecule of claim 26, wherein the at least one antigen binding site that binds specifically to CDH17 is an immunoglobulin (Ig) molecule and the at least one antigen binding site that binds specifically to TRAILR2 comprises one or more scFv(s).

29. The binding molecule of claim 28, wherein the one or more scFv(s) have a VL-VH orientation from N- to C-terminus.

30. The binding molecule of claim 28, wherein the one or more scFv(s) is fused to the C-terminus of the heavy chain of the Ig molecule.

31. The binding molecule of claim 28, wherein the Ig molecule is IgG.

32. The binding molecule of claim 28, wherein the one or more scFv(s) is fused to the Ig molecule by a peptide linker.

33. The binding molecule of claim 32, wherein the peptide linker having a length of about 4 to 20 amino acids.

34. A pharmaceutical composition comprising a binding molecule of claim 26 and a pharmaceutically acceptable carrier.

35. A binding molecule comprising at least one antigen binding site that binds specifically to TRAILR2 and at least one antigen binding site that binds specifically to CDH17, wherein said binding molecule comprises (i) a heavy chain comprising the amino acid sequence of SEQ ID NO. 196 and (ii) a light chain comprising the amino acid sequence of SEQ ID NO. 203.

36. A pharmaceutical composition comprising a binding molecule of claim 35 and a pharmaceutically acceptable carrier.

37. A binding molecule comprising at least one antigen binding site that binds specifically to TRAILR2 and at least one antigen binding site that binds specifically to CDH17, wherein said binding molecule comprises (i) a heavy chain comprising the amino acid sequence of SEQ ID NO. 197 and (ii) a light chain comprising the amino acid sequence of SEQ ID NO. 203.

38. A pharmaceutical composition comprising a binding molecule of claim 37 and a pharmaceutically acceptable carrier.

39. A binding molecule comprising at least one antigen binding site that binds specifically to TRAILR2 and at least one antigen binding site that binds specifically to CDH17, wherein said binding molecule comprises (i) a heavy chain comprising the amino acid sequence of SEQ ID NO. 211 and (ii) a light chain comprising the amino acid sequence of SEQ ID NO. 218.

40. A pharmaceutical composition comprising a binding molecule of claim 39 and a pharmaceutically acceptable carrier.

41. A binding molecule comprising at least one antigen binding site that binds specifically to TRAILR2 and at least one antigen binding site that binds specifically to CDH17, wherein said binding molecule comprises (i) a heavy chain comprising the amino acid sequence of SEQ ID NO. 212 and (ii) a light chain comprising the amino acid sequence of SEQ ID NO. 218.

42. A pharmaceutical composition comprising a binding molecule of claim 41 and a pharmaceutically acceptable carrier.

* * * * *